United States Patent
Cong et al.

(10) Patent No.: US 10,023,877 B2
(45) Date of Patent: *Jul. 17, 2018

(54) PHI-4 POLYPEPTIDES AND METHODS FOR THEIR USE

(71) Applicant: PIONEER HI-BRED INTERNATIONAL, INC., Johnston, IA (US)

(72) Inventors: Ruth Cong, Palo Alto, CA (US); Jingtong Hou, San Pablo, CA (US); Zhenglin Hou, Ankeny, IA (US); Phillip A. Patten, Menlo Park, CA (US); Takashi Yamamoto, Dublin, CA (US)

(73) Assignee: PIONEER HI-BRED INTERNATIONAL, INC. IA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/776,212

(22) PCT Filed: Mar. 12, 2014

(86) PCT No.: PCT/US2014/024524
§ 371 (c)(1),
(2) Date: Sep. 14, 2015

(87) PCT Pub. No.: WO2014/150914
PCT Pub. Date: Sep. 25, 2014

(65) Prior Publication Data
US 2016/0040184 A1     Feb. 11, 2016

Related U.S. Application Data

(60) Provisional application No. 61/859,883, filed on Jul. 30, 2013, provisional application No. 61/793,439, filed on Mar. 15, 2013.

(51) Int. Cl.
*C07K 14/195* (2006.01)
*C12N 15/82* (2006.01)
*A01N 63/02* (2006.01)

(52) U.S. Cl.
CPC ......... *C12N 15/8286* (2013.01); *A01N 63/02* (2013.01); *C07K 14/195* (2013.01); *C07K 2319/00* (2013.01); *Y02A 40/162* (2018.01)

(58) Field of Classification Search
None
See application file for complete search history.

(56) References Cited

U.S. PATENT DOCUMENTS

| 7,692,068 | B2  | 4/2010  | Carozzi et al. |
| 8,575,425 | B2* | 11/2013 | Desai ............ C12N 15/8285 800/279 |

| 2007/0172463 | A1 | 7/2007 | Martin et al. |
| 2011/0023184 | A1 | 1/2011 | Deswai et al. |
| 2014/0051829 | A1 | 2/2014 | Desai et al. |

FOREIGN PATENT DOCUMENTS

| WO | 01/16305 A2    | 3/2001 |
| WO | 2012038480 A2  | 3/2012 |
| WO | 2013/016617 A1 | 1/2013 |

OTHER PUBLICATIONS

Olsen et al. Trends Plant Sci 10(2):79-87 (2005).*
De Maagd, et al.; "How Bacillus thuringiensis has evolved specific toxins to colonize the insect world", Trends in Genetics, vol. 17, No. 4, p. 193-199 (2001).
Friedberg, et al.; "Automated protein function prediction—the genomic challenge", Briefings in Bioinformatics, vol. 7 No. 3, p. 225-242; (2006).
Gartemann, et al.; The Genome Sequence of the Tomato-Pathogenic Actinomycete *Clavibacter michiganensis* subsq. Michiganensis NCPPB382 Reveals a Large Island Involved in Pathogenicity:, Journal of Bacteriology, vol. 190, No. 6, p. 2138-2149 (2008).
Martin, et al.; "*Chromobacterium subtsugae* sp. nov., a betaproteobacterium toxic to Colorado potato beetele and other insect pests", International Journal of Systematic and Evolutionary Microbiology, vol. 57, p. 993-999 (2007).
Rosado, et al.; "The MACPF/CDC family of pore-forming toxins", Cellular Microbilogy, vol. 10, p. 1765-1774 (2008).
Rosado, et al.; "A Common Fold Mediates Vertebrate Defense and Bacterial Attack", Science, vol. 317, p. 1548, (2007).
Tounsi, S. et al.; "Cloning and study of the expression of a novel cryIIa-type gene from *Bacillus thuringiensis* subsp. *kursstaki*", Journal of Applied Microbiology, vol. 95, p. 23-28 (2003).
The International Search Report for International Application No. PCT/US2014/024524 dated Sep. 4, 2014.

* cited by examiner

*Primary Examiner* — Medina A Ibrahim

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest, as probes for the isolation of other homologous (or partially homologous) genes. The insecticidal proteins find use in controlling, inhibiting growth or killing lepidopteran, coleopteran, dipteran, fungal, hemipteran, and nematode pest populations and for producing compositions with insecticidal activity.

13 Claims, 5 Drawing Sheets

Fig. 3

Figure 1:
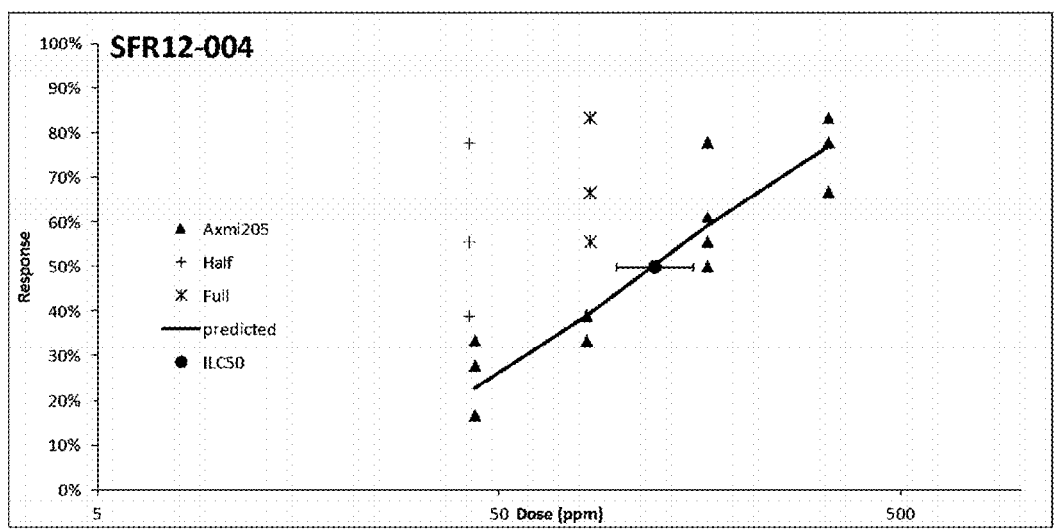

```
PHI-4c-ter    (1)   MVKAGEDSGSGASEDLAVFNPSTSNGYKMVGQFGQRNHASVADGHAPIFK    50
PHI-4c-ter   (51)   DLFDLGVLKAPVGWQRVWDDAGSGKSKDYACWRAIPPQGYRALGDVMMLA   100
PHI-4c-ter  (101)   TSGYNPPNLPDYVCVHQSLCADVQTLQNRVWWDKGTGARKDVSLWQPGAA   150
PHI-4c-ter  (151)   GAVASSCFAGVPNYNNPPNSGDIER                            175
```

PHI-4 POLYPEPTIDES AND METHODS FOR THEIR USE

REFERENCE TO SEQUENCE LISTING SUBMITTED ELECTRONICALLY

The official copy of the sequence listing is submitted electronically via EFS-Web as an ASCII formatted sequence listing with a file named "5414WOPCT_Sequence_Listing" created on Mar. 4, 2014, and having a size of 5,935 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences encoding them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards, and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including *Lepidoptera*, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Coleoptera. In addition, there remains a need for biopesticides having activity against a variety of insect pests that have developed resistance to existing pesticides.

SUMMARY

In one aspect compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In particular, isolated or recombinant nucleic acid molecules are provided encoding PHI-4 polypeptides including amino acid substitutions, amino acid deletions, amino acid insertions, and fragments thereof, and combinations thereof. Additionally, amino acid sequences corresponding to the PHI-4 polypeptides are encompassed. Nucleic acid sequences that are complementary to a nucleic acid sequence of the embodiments or that hybridize to a sequence of the embodiments are also encompassed.

In another aspect methods are provided for producing the polypeptides and for using those polypeptides for controlling, inhibiting growth or killing a Lepidopteran, Coleopteran, nematode, fungi, Hemipteran and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling coleopteran, lepidopteran, hemipteran or nematode pests. It will be understood by one of skill in the art that the transgenic plant may comprise any gene imparting an agronomic trait of interest.

In another aspect methods for detecting the nucleic acids and polypeptides of the embodiments in a sample are also included. A kit for detecting the presence of a PHI-4 polypeptide or detecting the presence of a nucleotide sequence encoding a PHI-4 polypeptide in a sample is provided. The kit is provided along with all reagents and control samples necessary for carrying out a method for detecting the intended agent, as well as instructions for use.

In another aspect the compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of PHI-4 polypeptides or nucleic acids in products or organisms.

The following embodiments are encompassed by the present disclosure.

Embodiment 1 is a PHI-4 polypeptide having improved insecticidal activity compared to AXMI-205 (SEQ ID NO: 35).

Embodiment 2 is the PHI-4 polypeptide of embodiment 1, wherein the insecticidal activity is increased about 1.5 fold or greater compared to AXMI-205 (SEQ ID NO: 35).

Embodiment 3 is the PHI-4 polypeptide of embodiment 1, wherein the insecticidal activity is increased about 2 fold or greater compared to AXMI-205 (SEQ ID NO: 35).

Embodiment 4 is the PHI-4 polypeptide of embodiment 1, wherein the insecticidal activity is increased about 2.5 fold or greater compared to AXMI-205 (SEQ ID NO: 35).

Embodiment 5 is the PHI-4 polypeptide of embodiment 1, wherein the insecticidal activity is increased about 3 fold or greater compared to AXMI-205 (SEQ ID NO: 35).

Embodiment 6 is the PHI-4 polypeptide of embodiment 1, wherein the insecticidal activity is increased about 5 fold or greater compared to AXMI-205 (SEQ ID NO: 35).

Embodiment 7 is the PHI-4 polypeptide of any one of embodiments 1-6, wherein the improved insecticidal activity compared to AXMI-205 (SEQ ID NO: 35) is against Western Corn Root Worm (WCRW) larvae.

Embodiment 8 is the PHI-4 polypeptide of any one of embodiments 1-7, wherein the improved insecticidal activity compared to AXMI-205 (SEQ ID NO: 35) is quantified as a Mean FAE Index.

Embodiment 9 is the PHI-4 polypeptide of any one of embodiments 1-7, wherein the improved insecticidal activity compared to AXMI-205 (SEQ ID NO: 35) is quantified as an EC50 value.

Embodiment 10 is the PHI-4 polypeptide of any one of embodiments 1-7, wherein the improved activity compared to AXMI-205 (SEQ ID NO: 35) is quantified as a Mean Deviation Score.

Embodiment 11 is the PHI-4 polypeptide of any one of embodiments 1-10, wherein the PHI-4 polypeptide comprises one or more amino acid substitutions compared to the native amino acid at position 40, 42, 43, 46, 52, 97, 98, 99, 145, 150, 151, 153, 163, 171, 172, 182, 196, 206, 210, 216, 220, 278, 283, 289, 293, 328, 333, 334, 336, 338, 339, 342, 346, 354, 355, 370, 389, 393, 396, 401, 402, 403, 410, 412, 416, 417, 426, 442, 447, 452, 454, 455, 457, 461, 462, 500, 509, 520 or 527 of SEQ ID NO: 35.

Embodiment 12 is the PHI-4 polypeptide of embodiment 11, wherein the amino acid at position 40 is Leu or Ile; the amino acid at position 42 is Asp or Asn; the amino acid at position 43 is Phe or Glu; the amino acid at position 46 is Glu or Asn; the amino acid at position 52 is Ile or Val; the amino acid at position 97 is Arg, Asp, Glu or Asn; the amino acid at position 98 is Tyr or Phe; the amino acid at position 99 is Lys or Leu; the amino acid at position 145 is Leu or Val; the amino acid at position 150 is Arg or Gln; the amino acid at position 151 is Asp or Ser; the amino acid at position 153 is Leu or Ile; the amino acid at position 163 is Leu or Val; the amino acid at position 171 is Tyr or Phe; the amino acid at position 172 is Ile or Leu; the amino acid at position 182 is Asp or Gln; the amino acid at position 196 is Gln or Asn; the amino acid at position 206 is Tyr or Phe; the amino acid at position 210 is Val or Ile; the amino acid at position 216 is Glu or Gln; the amino acid at position 220 is Glu, Gln, His or Asp; the amino acid at position 278 is Glu or Asn; the amino acid at position 283 is Ile or Val; the amino acid at position 289 is Lys, Gln or Leu; the amino acid at position 293 is Arg, Gln or Glu; the amino acid at position 328 is Lys or Glu; the amino acid at position 333 is Ser, Lys or Val; the amino acid at position 334 is Gly, Lys or Arg; the amino acid at position 336 is Gly or Ala; the amino acid at position 338 is Ser or Val; the amino acid at position 339 is Glu, Asn or Gln; the amino acid at position 342 is Ala or Ser; the amino acid at position 346 is Pro or Ala; the amino acid at position 354 is Met or Leu; the amino acid at position 355 is Val or Ile; the amino acid at position 370 is His or Arg; the amino acid at position 389 is Trp or Leu; the amino acid at position 393 is Trp or Leu; the amino acid at position 396 is Ala, Leu, Lys, Thr or Gly; the amino acid at position 401 is Ser, His, Gly, Lys or Pro; the amino acid at position 402 is Lys, His, Gly or Trp; the amino acid at position 403 is Asp or Tyr; the amino acid at position 410 is Ile or Val; the amino acid at position 412 is Pro or Ala; the amino acid at position 416 is Arg or Glu; the amino acid at position 417 is Ala or Ser; the amino acid at position 426 is Thr or Ser; the amino acid at position 442 is Gln or Glu; the amino acid at position 447 is Asp or Lys; the amino acid at position 452 is Gln or Lys; the amino acid at position 454 is Arg or Gln; the amino acid at position 455 is Val or Ile; the amino acid at position 457 is Trp or Asn; the amino acid at position 461 is Thr or Ser; the amino acid at position 462 is Gly or Ala; the amino acid at position 500 is Arg or Gln; the amino acid at position 509 is Lys or Gln; the amino acid at position 520 is Lys, Glu or Gln; and the amino acid at position 527 is Gln or Lys.

Embodiment 13 is the PHI-4 polypeptide of embodiment 11 or 12, further comprising one or more amino acid substitutions at position 86, 359, 464, 465, 466, 467, 468, 499 or 517.

Embodiment 14 is the PHI-4 polypeptide of embodiment 13, wherein the amino acid at position 86 is Glu or Thr; the amino acid at position 359 is Gly or Ala; the amino acid at position 464 is Arg, Ala, Lys, Asp or Asn; the amino acid at position 465 is Lys or Met, the amino acid at position 467 is Val, Ala, Leu or Thr; the amino acid at position 468 is Ser or Leu; the amino acid at position 499 is Glu or Ala or the amino acid at position 517 is Glu or Arg.

Embodiment 15 is the PHI-4 polypeptide of any one of embodiments 1-12, having 1 to 54 amino acid substitutions compared to SEQ ID NO: 35.

Embodiment 16 is the PHI-4 polypeptide of any one of embodiments 1-12, having 1 to 27 amino acid substitutions compared to SEQ ID NO: 35.

Embodiment 17 is the PHI-4 polypeptide of any one of embodiments 1-12, having 1 to 20 amino acid substitutions compared to SEQ ID NO: 35.

Embodiment 18 is the PHI-4 polypeptide of any one of embodiments 1-12, having 1 to 15 amino acid substitutions compared to SEQ ID NO: 35.

Embodiment 19 is the PHI-4 polypeptide of any one of embodiments 13 or 14, comprising 2 to 54 amino acid substitutions compared to SEQ ID NO: 35.

Embodiment 20 is the PHI-4 polypeptide of any one of embodiments 13 or 14, comprising 2 to 27 amino acid substitutions compared to SEQ ID NO: 35.

Embodiment 21 is the PHI-4 polypeptide of any one of embodiments 13 or 14, comprising 2 to 20 amino acid substitutions compared to SEQ ID NO: 35.

Embodiment 22 is the PHI-4 polypeptide of any one of embodiments 13 or 14, comprising 2 to 15 amino acid substitutions compared to SEQ ID NO: 35.

Embodiment 23 is the PHI-4 polypeptide of any one of embodiments 1-22, wherein the PHI-4 polypeptide has at least 80% identity to SEQ ID NO: 35.

Embodiment 24 is the PHI-4 polypeptide of any one of embodiments 1-22, wherein the PHI-4 polypeptide has at least 90% identity to SEQ ID NO: 35.

Embodiment 25 is the PHI-4 polypeptide of any one of embodiments 1-22, wherein the PHI-4 polypeptide has at least 95% identity to SEQ ID NO: 35.

Embodiment 26 is the PHI-4 polypeptide of any one of embodiments 1-22, wherein the PHI-4 polypeptide has at least 97% identity to SEQ ID NO: 35.

Embodiment 27 is a PHI-4 polypeptide, comprising at least one amino acid substitution at a residue relative to SEQ ID NO: 35 in a structural domain selected from:

a hydrophilic residue;

a residue in a membrane insertion initiation loop;

a residue in a receptor binding loop; and a residue in a protease sensitive region, wherein the PHI-4 polypeptide has increased insecticidal activity compared to the polypeptide of SEQ ID NO: 35.

Embodiment 28 is the PHI-4 polypeptide of embodiment 27, wherein the hydrophilic residues are Asp, Glu, Lys, Arg, His, Ser, Thr, Tyr, Trp, Asn, Gln, and Cys.

Embodiment 29 is the PHI-4 polypeptide of embodiment 27 or 28, wherein the membrane insertion loops are between about the amino acid at position 92 (Val) and about the amino acid at position 101 (Ala) and between about the amino acid at position 211 (Gly) and about the amino acid at position 220 (Glu), relative to SEQ ID NO: 35.

Embodiment 30 is the PHI-4 polypeptide of embodiment 29, wherein the membrane insertion initiation loop residue is selected from position 92, 93, 94, 95, 96, 97, 98, 99, 100, 101, 102, 103, 211, 212, 213, 214, 215, 216, 217, 218, 219, 220 of SEQ ID NO: 35.

Embodiment 31 is the PHI-4 polypeptide of any one of embodiments 27-30, wherein the receptor binding loops are between about the amino acid at position 332 (Asp) and about the amino acid at position 340 (Asp), between about the amino acid at position 395 (Asp) and about the amino acid at position 403 (Asp), between amino acid at position 458 (Asp) and about the amino acid at position 466 (Asp) relative to SEQ ID NO: 35.

Embodiment 32 is the PHI-4 polypeptide of embodiment 31, wherein the receptor binding loop residue is selected from positions 332, 333, 334, 335, 336, 337, 338, 339, 340, 395, 396, 397, 398, 399, 400, 401, 402, 403, 458, 459, 460, 461, 462, 463, 464, 465, 466 of SEQ ID NO: 35.

Embodiment 33 is the PHI-4 polypeptide of any one of embodiments 27-32, wherein the protease sensitive region residue is selected from between about the amino acid at position 305 (Lys) and about the amino acid at position 316 (Lys) and from about the amino acid at position 500 (Arg) and about the amino acid at position 535 (Lys) relative to SEQ ID NO: 35.

Embodiment 34 is the PHI-4 polypeptide of embodiment 27, wherein the protease is trypsin.

Embodiment 35 is the PHI-4 polypeptide of any one of embodiments 27-34, wherein the PHI-4 polypeptide has at least 80% sequence identity to SEQ ID NO: 35.

Embodiment 36 is the PHI-4 polypeptide of any one of embodiments 27-34, wherein the PHI-4 polypeptide has at least 90% sequence identity to SEQ ID NO: 35.

Embodiment 37 is the PHI-4 polypeptide of any one of embodiments 27-34, wherein the PHI-4 polypeptide has at least 95% sequence identity to SEQ ID NO: 35.

Embodiment 38 is the PHI-4 polypeptide of any one of embodiments 27-34, wherein the PHI-4 polypeptide has at least 97% sequence identity to SEQ ID NO: 35.

Embodiment 39 is a PHI-4 polypeptide, comprising an amino acid sequence of the formula,

```
                                                   (SEQ ID NO: 3)
             5                          10
Met Xaa Ser Ala Ala Asn Ala Gly Xaa Leu Gly Asn 15                         20
Leu Xaa Gly Xaa Thr Ser Xaa Gly Met Xaa Tyr Xaa 25                      30                      35
Val Asn Gly Leu Tyr Ala Ser Pro Glu Ser Leu Xaa 40                         45
Gly Gln Pro Leu Phe Xaa Xaa Gly Gly Xaa Leu Asp 50                         55                      60
Ser Xaa Xaa Ile Glu Gly Xaa Xaa Xaa Xaa Phe Pro 65                     70
Xaa Ser Met His Val His Thr Tyr Phe His Ser Asp 75                         80
Xaa Xaa Gln Xaa Val Ser Xaa Xaa Ile Xaa Xaa Xaa 85                          90                      95
Arg Xaa Xaa Xaa Ser Xaa His Val Gly Xaa Ser Gly 100                     105
Xaa Xaa Xaa Leu Phe Ser Xaa Ser Xaa Ser Val Asp 110                     115                         120
Xaa Thr Thr Xaa Xaa Gln Gln Leu Xaa Glu Ile Thr 125                     130
Xaa Ser Ser Thr Arg Glu Xaa His Val Leu Trp Tyr 135                         140
Ile Ser Leu Pro Gly Ala Ala Thr Leu Xaa Ser Met 145                         150                         155
Leu Xaa Xaa Xaa Xaa Xaa Xaa Asp Xaa Xaa Xaa Pro 160                     165
Asn Met Xaa Ala Met Xaa Leu Phe Xaa Xaa Xaa Gly 170                         175                         180
Pro Xaa Xaa Xaa Xaa Xaa Ala Ala Val Gly Gly Arg 185                     190
Leu Xaa Xaa Xaa Xaa Ala Ser Lys Xaa Leu Xaa Met 195                     200
Xaa Ser Ser Xaa Ser Leu Ser Thr Thr Xaa Xaa Xaa 205                         210                         215
Ser Xaa Xaa Ala Xaa Xaa Gly Glu Ile Xaa Ile Xaa 220                     225
His Gly Ser Xaa Met Glu Lys Gln Val Asn Ser Phe 230                     235                         240
Xaa Xaa Xaa Ser Thr Ile Arg Xaa Thr Ala Thr Gly 245                     250
Gly Lys Pro Gly Xaa Thr Xaa Arg Ile Leu His Gly 255                     260
Pro Asp Ser Xaa Xaa Ala Phe Ser Xaa Trp Ala Xaa 265                     270                         275
Ser Leu Leu Xaa Tyr Ala Thr Leu Met Asp Phe Xaa 280                     285
Thr Xaa Ser Leu Xaa Xaa Ile Xaa Ala Leu Xaa Asp 290                         295                         300
Xaa Pro Xaa Xaa Xaa Xaa Glu Xaa Xaa Xaa Ala Xaa 305                     310
```

```
                -continued
Pro Xaa Xaa Met Xaa Xaa Ser Gln Xaa Ser Ile Pro
            315                 320
Xaa Val Asp Xaa Val Leu Leu Met Asp Ala Arg Pro
325                 330                 335
Pro Met Val Xaa Ala Gly Xaa Asp Xaa Xaa Xaa
                340                 345
Xaa Xaa Xaa Asp Xaa Xaa Xaa Xaa Xaa Ser Thr
        350                 355                 360
Ser Xaa Xaa Tyr Lys Xaa Xaa Gly Gln Phe Xaa Gln
                    365                 370
Arg Xaa His Xaa Ser Val Ala Asp Gly His Xaa Pro
                375                 380
Ile Xaa Xaa Asp Leu Phe Asp Xaa Gly Xaa Xaa Xaa
385                 390                 395
Xaa Pro Val Gly Xaa Gln Xaa Val Trp Asp Xaa Xaa
                400                 405
Xaa Xaa Gly Lys Xaa Xaa Xaa Tyr Xaa Cys Trp Arg
        410                 415                 420
Xaa Xaa Xaa Xaa Gln Gly Tyr Xaa Xaa Xaa Gly Asp
                    425                 430
Val Xaa Met Leu Ala Xaa Ser Gly Tyr Asn Pro Pro
            435                 440
Asn Leu Pro Xaa Xaa Xaa Cys Xaa His Xaa Ser Leu
445                 450                 455
Xaa Ala Xaa Xaa Xaa Thr Leu Xaa Xaa Xaa Xaa Trp
                460                 465
Xaa Asp Xaa Xaa Xaa Xaa Xaa Xaa Xaa Val Ser
        470                 475                 480
Leu Trp Xaa Xaa Gly Ala Ala Gly Ala Val Ala Ser
                    485                 490
Ser Cys Phe Ala Gly Val Pro Asn Tyr Asn Asn Pro
            495                 500
Pro Asn Ser Gly Xaa Ile Xaa Xaa Leu Xaa Gly Ser
505                 510                 515
Ile Ala Cys Val Xaa Thr Ser Ala Ile Ala Ser Met
                520                 525
Xaa Xaa Met Xaa Ser Met Leu Ser Xaa His Xaa Gly
        530                 535
Met Glu Ala Met Met Ser Lys Leu,
```
wherein
Xaa at position 2 is Ala or Arg; Xaa at position 9 is Gln, Lys or Glu; Xaa at position 14 is Pro or Ala; Xaa at position 16 is Val or Asp; Xaa at position 19 is Met or Leu; Xaa at position 22 is Gly or Ser; Xaa at position 24 is Asp, Asn or Gln; Xaa at position 36 is Leu or Met; Xaa at position 42 is Asp, Asn or Gln; Xaa at position 43 is Phe or Glu; Xaa at position 46 is Glu, Asp, Asn or Gly; Xaa at position 50 is Ile or Val; Xaa at position 51 is Glu or Gln; Xaa at position 55 is Arg or Lys; Xaa at position 56 is Ser or Thr; Xaa at position 57 is Tyr or Phe; Xaa at position 58 is Thr or Ser; Xaa at position 61 is Arg, Lys or Glu; Xaa at position 73 is Phe or Tyr; Xaa at position 74 is Lys, Glu, Gly, Arg, Met, Leu, His or Asp; Xaa at position 76 is Asp or Gln; Xaa at position 79 is Lys or Glu; Xaa at position 80 is Glu or Ser; Xaa at position 82 is Glu, Ile, Leu, Tyr or Gln; Xaa at position 83 is Glu or Gln; Xaa at position 84 is Tyr or Phe; Xaa at position 86 is Glu or Gln; Xaa at position 87 is Lys or Gln; Xaa at position 88 is Met, Ile or Leu; Xaa at position 90 is Gln or Glu; Xaa at position 94 is Val or Ile; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile, Met, Phe, Cys, Val or Asn; Xaa at position 103 is Ala or Gly; Xaa at position 105 is Leu or Ile; Xaa at position 109 is Phe, Lys, Gly, Met, Ser, Asp, Asn, Glu, Cys, Ala or Arg; Xaa at position 112 is Thr or Ser; Xaa at position 113 is Asp, Glu or Met; Xaa at position 117 is Thr or Ser; Xaa at position 121 is Tyr or Phe; Xaa at position 127 is Ala or Thr; Xaa at position 142 is Arg or Glu; Xaa at position 146 is Arg or Gln; Xaa at position 147 is Arg, Glu or Gln; Xaa at position 148 is Asp, Phe, Pro, Val, Glu, His, Trp, Ala, Arg, Leu, Ser, Gln or Gly; Xaa at position 149 is Phe or Val; Xaa at position 150 is Arg, Gln, Glu or Asn; Xaa at position 151 is Asp, Ser, Ala, Asn, Trp, Val, Gln, Cys, Met, Leu, Arg or Glu; Xaa at position 153 is Leu or Ile; Xaa at position 154 is Asn or Asp; Xaa at position 155 is Asn or Lys; Xaa at position 159 is Pro or Asp; Xaa at position 162 is Glu, Asp, Gln, Asn or Leu; Xaa at position 165 is Lys, Glu, Gln, Pro, Thr, Ala, Leu, Gly, Asp, Val, His, Ile, Met, Trp, Phe, Tyr or Arg; Xaa at position 166 is Arg or Gln; Xaa at position 167 is Tyr, Trp or Cys; Xaa at position 170 is Tyr or His; Xaa at position 171 is Tyr or Phe; Xaa at position 172 is Ile, Leu or Val; Xaa at position 173 is Ser or Ala; Xaa at position 174 is Glu, Gln, Asn, Lys, Val or Ser; Xaa at position 182 is Asp or Gln; Xaa at position 183 is Tyr or Val; Xaa at position 184 is Ser or Thr; Xaa at position 185 is Ala or Ser; Xaa at position 189 is Thr, Lys or Ile; Xaa at position 191 is Lys or Gln; Xaa at position 193 is Asp or Asn; Xaa at position 196 is Gln, Lys, Asn, Asp, Glu, Ala, Ile or Arg; Xaa at position 202 is Ala or Val; Xaa at position 203 is Glu, Thr or His; Xaa at position 204 is Met or Ala; Xaa at position 206 is Tyr or Phe; Xaa at position 207 is Lys or Gln; Xaa at position 209 is Leu or Pro; Xaa at position 210 is Val or Ile; Xaa at position 214 is Lys, Ser or Gln; Xaa at position 216 is Glu, Gln, Phe, Val, Tyr or Arg; Xaa at position 220 is Glu, His, Asp, Thr, Tyr, Val, Ser, Gln, Arg, Trp, Met, Ala, Phe, Ile, Leu, Cys or Asn; Xaa at position 229 is Arg or Glu; Xaa at position 230 is Ser or Glu; Xaa at position 231 is Asn or Ser; Xaa at position 236 is Leu or Pro; Xaa at position 245 is Met or Leu; Xaa at position 247 is Asp or Tyr; Xaa at position 256 is Gln, Lys or Glu; Xaa at position 257 is Gln, Ile, Glu, Cys, Ser, His, Trp or Met; Xaa at position 261 is Gln, Glu, Lys or Ala; Xaa at position 264 is Glu or Gln; Xaa at position 268 is Asp or Asn; Xaa at position 276 is Ser or Ala; Xaa at position 278 is Glu, Asn or Gln; Xaa at position 281 is Gln, Lys or Glu; Xaa at position 282 is Pro or Gly; Xaa at position 284 is Trp or Arg; Xaa at position 287 is Ala or Cys; Xaa at position 289 is Lys, Leu, Val, Pro, Glu, Gln, Tyr, Thr, Asp, Phe, Ser, Met, Arg, Trp, Ile, His, Asn, Cys, Gly or Ala; Xaa at position 291 is Glu or Gln; Xaa at position 292 is Arg or Gln; Xaa at position 293 is Arg, Glu or Gln; Xaa at position 294 is Val or Ala; Xaa at position 296 is Leu or Ile; Xaa at position 297 is Glu or Gln; Xaa at position 298 is Asp or Gln; Xaa at position 300 is Phe or Tyr; Xaa at position 302 is Glu or Gln; Xaa at position 303 is Phe or Tyr; Xaa at position 305 is Lys, Gln, Ala, Ile, Met, Asn, Thr or Val; Xaa at position 306 is Gln or Lys; Xaa at position 309 is Gln, Lys or Glu; Xaa at position 313 is Lys, Gln or Arg; Xaa at position 316 is Lys or Gln; Xaa at position 328 is Lys, Glu or Gln; Xaa at position 331 is Glu, Asn or Gln; Xaa at position 333 is Ser, Arg, Ala, Gly, Lys, Val, Asn, Ala, His, Gln, Thr, Asp, Ile, Leu, Cys or Glu; Xaa at position 334 is Gly, Arg, Lys, Ile or Trp; Xaa at position 335 is Ser or Ala; Xaa at position 336 is Gly or Ala; Xaa at position 337 is Ala, Val or Gly; Xaa at position 338 is Ser, His, Val, Lys, Ala, Gly, Thr, Ile, Glu, Met, Arg, Pro, Asp, Asn or Leu; Xaa at position 339 is Glu, Asn, Gln, Ile, Pro, Met, Ser, Ala, Cys, Phe, Val, Leu, Asp, Trp, His or Arg; Xaa at position 341 is Leu or Val; Xaa at position 342 is Ala, Ser or Val; Xaa at position 343 is Val or Ile; Xaa at position 344 is Phe or Trp; Xaa at position 345 is Asn or His; Xaa at position 346 is Pro or Ala; Xaa at position 350 is Asn or Ser; Xaa at position 351 is Gly or Val; Xaa at position 354 is Met or Leu; Xaa at position 355 is Val, Ile or Leu; Xaa at position 359 is Gly or Ala; Xaa at position 362 is Asn or Ser; Xaa at position 364 is Ala or Ser; Xaa at position 371 is Ala, Gly or Thr; Xaa at position 374 is Phe or Ile; Xaa at position 375 is Lys or Arg; Xaa at position 380 is Leu or Gly; Xaa at position 382 is Val, Asp or Leu; Xaa at position 383 is Leu, Ile or Val; Xaa at position 384 is Lys, Ala or Gly; Xaa at position 385 is Ala or Gly; Xaa at position 389 is Trp or Tyr; Xaa at position 391 is Arg, Leu, Glu, Gln, Asp or His; Xaa at position 395 is Asp or Cys; Xaa at position 396 is Ala, Leu, Lys, Asn, Gly, Ile, Met, Arg, Tyr, Gln, His or Thr; Xaa at position 397 is Gly, Arg or Ala; Xaa at position 398 is Ser, Gln or Cys; Xaa at position 401 is Ser, His, Pro, Gly, Lys, Val, Arg, Ile, Asn, Phe, Thr, Ala, Asp, Met, Gln or Glu; Xaa at position 402 is Lys, Phe, His, Arg, Trp, Gly, Asn, Leu, Tyr, Thr, Val, Met, Pro or Ala; Xaa at position 403 is Asp, Tyr, Trp, Phe or Glu; Xaa at position 405 is Ala or Ser; Xaa at position 409 is Ala or Pro; Xaa at position 410 is Ile or Val; Xaa at position 411 is Pro or Ala; Xaa at position 412 is Pro or Ala; Xaa at position 416 is Arg, Glu or Gln; Xaa at position 417 is Ala, Ser or Cys; Xaa at position 418 is Leu or Met; Xaa at position 422 is Met or Val; Xaa at position 426 is Thr or Ser; Xaa at position 436 is Asp or Lys; Xaa at position 437 is Tyr or Val; Xaa at position 438 is Val or Arg; Xaa at position 440 is Val or Leu; Xaa at position 442 is Gln, Lys or Glu; Xaa at position 445 is Cys, Leu or Thr; Xaa at position 447 is Asp, Lys, Tyr, Ser, Glu, Ile, Gly, Pro, Leu, Phe, Trp or Thr; Xaa at position 448 is Val or Ala; Xaa at position 449 is Gln or Glu; Xaa at position 452 is Gln, Lys or Glu, Ala; Xaa at position 453 is Asn or Asp; Xaa at position 454 is Arg, Tyr, Met, Ser, Val, Ile, Lys, Phe, Trp, Gln, Gly, His, Asp, Leu, Thr, Pro or Asn; Xaa at position 455 is Val or Ile; Xaa at position 457 is Trp or Asn; Xaa at position 459 is Lys, Met, Val, Trp, Gln, Ile, Thr, Ser, His, Cys, Tyr, Pro, Asn, Ala, Arg or Glu; Xaa at position 460 is Gly or Ala; Xaa at position 461 is Thr or Ser; Xaa at position 462 is Gly or Ala; Xaa at position 463 is Ala, Ser or Gly; Xaa at position 464 is Arg, Gly, His, Gln, Thr, Phe, Ala, Asp, Ser or Lys; Xaa at position 465 is Lys, Asn, Val, Met, Pro, Gly, Arg, Thr, His, Cys, Trp, Phe or Leu; Xaa at position 466 is Asp or Arg; Xaa at position 471 is Gln, Lys, Glu or Met; Xaa at position 472 is Pro or Ser; Xaa at position 497 is Asp or Gln; Xaa at position 499 is Glu or Gln; Xaa at position 500 is Arg, Gln or Lys; Xaa at position 502 is Arg, Glu or Gln; Xaa at position 509 is Lys, Gln, Glu or Ala; Xaa at position 517 is Gln, Cys, Asn, Val or Pro; Xaa at position 518 is Glu or Gln; Xaa at position 520 is Lys, Gln, Glu, His or Ala; Xaa at position 525 is Gln or Lys; and Xaa at position 527 is Gln, Lys, Pro, Cys, Glu, Ser, His, Phe or Trp; wherein one or more amino acid(s) designated by Xaa in SEQ ID NO: 3 is an amino acid different from the corresponding amino acid of SEQ ID NO: 35 and wherein the PHI-4 polypeptide has increased insecticidal activity compared to the polypeptide of SEQ ID NO: 35.

Embodiment 40 is a PHI-4 polypeptide, comprising an amino acid sequence of the formula (SEQ ID NO: 4)

```
                 5                  10
Met Xaa Ser Ala Ala Asn Ala Gly Gln Leu Gly Asn 15                  20
Leu Pro Gly Val Thr Ser Met Gly Met Gly Tyr Xaa 25                  30                  35
Val Asn Gly Leu Tyr Ala Ser Pro Glu Ser Leu Leu 40                  45
Gly Gln Pro Leu Phe Xaa Xaa Gly Gly Xaa Leu Asp 50                  55                  60
Ser Ile Glu Ile Glu Gly Arg Ser Tyr Thr Phe Pro 65                  70
Arg Ser Met His Val His Thr Tyr Phe His Ser Asp 75                  80
Phe Xaa Gln Asp Val Ser Xaa Glu Ile Xaa Glu Tyr 85                  90                  95
Arg Glu Lys Met Ser Gln His Val Gly Val Ser Gly 100                 105
Xaa Xaa Xaa Leu Phe Ser Ala Ser Leu Ser Val Asp 110                 115                 120
Xaa Thr Thr Thr Asp Gln Gln Leu Thr Glu Ile Thr 125                 130
Tyr Ser Ser Thr Arg Glu Ala His Val Leu Trp Tyr 135                 140
Ile Ser Leu Pro Gly Ala Ala Thr Leu Arg Ser Met 145                 150                 155
Leu Arg Xaa Xaa Phe Xaa Xaa Asp Xaa Asn Asn Pro 160                 165
Asn Met Pro Ala Met Xaa Leu Phe Xaa Xaa Tyr Gly 170                 175                 180
Pro Tyr Xaa Ile Ser Xaa Ala Ala Val Gly Gly Arg 185                 190
Leu Xaa Tyr Ser Ala Ala Ser Lys Thr Leu Lys Met 195                 200
Asp Ser Ser Xaa Ser Leu Ser Thr Thr Ala Xaa Met 205                 210                 215
Ser Xaa Lys Ala Leu Val Gly Glu Ile Lys Ile Xaa 220                 225
His Gly Ser Xaa Met Glu Lys Gln Val Asn Ser Phe 230                 235                 240
Arg Ser Asn Ser Thr Ile Arg Leu Thr Ala Thr Gly 245                 250
Gly Lys Pro Gly Met Thr Xaa Arg Ile Leu His Gly 255                 260
Pro Asp Ser Xaa Xaa Ala Phe Ser Xaa Trp Ala Glu 265                 270                 275
Ser Leu Leu Asp Tyr Ala Thr Leu Met Asp Phe Ser 280                 285
Thr Xaa Ser Leu Xaa Pro Ile Trp Ala Leu Ala Asp 290                 295                 300
Xaa Pro Glu Arg Xaa Val Glu Leu Glu Asp Ala Phe 305                 310
Pro Glu Phe Met Lys Gln Ser Gln Gln Ser Ile Pro 315                 320
Xaa Val Asp Lys Val Leu Leu Met Asp Ala Arg Pro
```

-continued

```
            325                 330                 335
Pro Met Val Xaa Ala Gly Glu Asp Xaa Xaa Ser Xaa 340                 345
Ala Xaa Xaa Asp Leu Ala Xaa Phe Asn Xaa Ser Thr 350                 355                 360
Ser Asn Gly Tyr Lys Met Xaa Gly Gln Phe Xaa Gln 365                 370
Arg Asn His Ala Ser Val Ala Asp Gly His Ala Pro 375                 380
Ile Phe Lys Asp Leu Phe Asp Leu Gly Val Leu Lys 385                 390                 395
Ala Pro Val Gly Trp Gln Xaa Val Trp Asp Asp Xaa 400                 405
Gly Ser Gly Lys Xaa Xaa Xaa Tyr Ala Cys Trp Arg 410                 415                 420
Ala Ile Xaa Xaa Gln Gly Tyr Xaa Xaa Xaa Gly Asp 425                 430
Val Met Met Leu Ala Xaa Ser Gly Tyr Asn Pro Pro 435                 440
Asn Leu Pro Asp Tyr Val Cys Xaa His Gln Ser Leu 445                 450                 455
Cys Ala Xaa Val Gln Thr Leu Xaa Asn Xaa Xaa Trp 460                 465
Trp Asp Xaa Gly Xaa Xaa Xaa Xaa Xaa Asp Val Ser 470                 475                 480
Leu Trp Xaa Xaa Gly Ala Ala Gly Ala Val Ala Ser 485                 490
Ser Cys Phe Ala Gly Val Pro Asn Tyr Asn Asn Pro 495                 500
Pro Asn Ser Gly Asp Ile Glu Xaa Leu Arg Gly Ser 505                 510                 515
Ile Ala Cys Val Xaa Thr Ser Ala Ile Ala Ser Met 520                 525
Gln Glu Met Xaa Ser Met Leu Ser Gln His Xaa Gly 530                 535
Met Glu Ala Met Met Ser Lys Leu,
``` wherein
Xaa at position 2 is Ala or Arg; Xaa at position 24 is Asp or Asn; Xaa at position 42 is Asp or Asn; Xaa at position 43 is Phe or Glu; Xaa at position 46 is Glu or Asn; Xaa at position 74 is Lys, Glu or Gly; Xaa at position 79 is Lys or Glu; Xaa at position 82 is Glu, Ile, Leu or Tyr; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile or Met; Xaa at position 109 is Phe, Lys, Gly, Met, Ser, Asp or Asn; Xaa at position 147 is Arg or Glu; Xaa at position 148 is Asp, Phe or Pro; Xaa at position 150 is Arg, Gln, Glu or Asn; Xaa at position 151 is Asp, Ser, Ala or Asn; Xaa at position 153 is Leu or Ile; Xaa at position 162 is Glu, Asp, Gln, Asn or Leu; Xaa at position 165 is Lys, Glu or Gln; Xaa at position 166 is Arg or Gln; Xaa at position 171 is Tyr or Phe; Xaa at position 174 is Glu, Gln, Asn, Lys, Val or Ser; Xaa at position 182 is Asp or Gln; Xaa at position 196 is Gln, Lys, Asn or Asp; Xaa at position 203 is Glu, Thr or His; Xaa at position 206 is Tyr or Phe; Xaa at position 216 is Glu or Gln; Xaa at position 220 is Glu, His, Asp, Thr, Tyr, Val, Ser or Gln; Xaa at position 247 is Asp or Tyr; Xaa at position 256 is Gln or Lys; Xaa at position 257 is Gln or Ile; Xaa at position 261 is Gln, Glu, Lys or Ala; Xaa at position 278 is Glu or Asn; Xaa at position 281 is Gln, Lys or Glu; Xaa at position 289 is Lys, Leu, Val, Pro, Glu, Gln, Tyr, Thr or Asp; Xaa at position 293 is Arg, Glu or Gln; Xaa at position 313 is Lys or Gln; Xaa at position 328 is Lys, Glu or Gln; Xaa at position 333 is Ser, Gly, Lys, Val or Asn; Xaa at position 334 is Gly, Arg, Lys or Ile; Xaa at position 336 is Gly or Ala; Xaa at position 338 is Ser, His, Val, Lys or Ala; Xaa at position 339 is Glu, Asn, Ile or Pro; Xaa at position 343 is Val or Ile; Xaa at position 346 is Pro or Ala; Xaa at position 355 is Val or Ile; Xaa at position 359 is Gly or Ala; Xaa at position 391 is Arg, Leu, Glu, Gln, Asp or His; Xaa at position 396 is Ala, Leu, Lys, Asn, Gly or Thr; Xaa at position 401 is Ser, His, Pro, Gly, Lys, Val or Arg; Xaa at position 402 is Lys, Phe, His, Arg, Gly, Trp, Thr, Asn, Tyr or Met; Xaa at position 403 is Asp or Tyr; Xaa at position 411 is Pro or Ala; Xaa at position 412 is Pro or Ala; Xaa at position 416 is Arg or Glu; Xaa at position 417 is Ala or Ser; Xaa at position 418 is Leu or Met; Xaa at position 426 is Thr or Ser; Xaa at position 440 is Val or Leu; Xaa at position 447 is Asp, Lys, Tyr, Ser, Glu or Ile; Xaa at position 452 is Gln, Lys or Glu; Xaa at position 454 is Arg, Tyr, Met, Ser, Val, Ile, Lys, Phe, Trp or Gln; Xaa at position 455 is Val or Ile; Xaa at position 459 is Lys, Met, Val, Trp, Gln, Ile or Tyr; Xaa at position 461 is Thr or Ser; Xaa at position 462 is Gly or Ala; Xaa at position 463 is Ala or Ser; Xaa at position 464 is Arg, Gly, His, Ala, Asp, Ser or Lys; Xaa at position 465 is Lys, Asn, Val, Met, Pro, Gly or Arg; Xaa at position 471 is Gln, Lys, Glu or Met; Xaa at position 472 is Pro or Ser; Xaa at position 500 is Arg or Gln; Xaa at position 509 is Lys, Gln or Ala; Xaa at position 520 is Lys, Gln, Glu, His or Ala; and Xaa at position 527 is Gln, Lys, Pro, Cys or Glu; wherein one or more amino acid(s) designated by Xaa in SEQ ID NO: 4 is an amino acid different from the corresponding amino acid of SEQ ID NO: 35 and wherein the PHI-4 polypeptide has increased insecticidal activity compared to the polypeptide of SEQ ID NO: 35.

Embodiment 41 is the PHI-4 polypeptide of embodiment 39 or 40, further comprising one or more amino acid substitutions at position 86, 359, 464, 465, 466, 467, 468, 499 or 517 of SEQ ID NO: 3 or SEQ ID NO: 4.

Embodiment 42 is the PHI-4 polypeptide of embodiment 41, wherein the amino acid at position 86 is Glu or Thr; the amino acid at position 359 is Gly or Ala; the amino acid at position 464 is Arg, Ala, Lys, Asp or Asn; the amino acid at position 465 is Lys or Met, the amino acid at position 467 is Val, Ala, Leu or Thr; the amino acid at position 468 is Ser or Leu; the amino acid at position 499 is Glu or Ala or the amino acid at position 517 is Glu or Arg.

Embodiment 43 is the PHI-4 polypeptide of embodiment 39-42, further comprising one or more conservative amino acid substitution, insertion of one or more amino acids, deletion of one or more amino acids, and combinations thereof.

Embodiment 44 is the PHI-4 polypeptide of any one of embodiments 39-43, wherein the insecticidal activity is increased about 1.5 fold or greater compared to AXMI-205 (SEQ ID NO: 35).

Embodiment 45 is the PHI-4 polypeptide of any one of embodiments 39-43, wherein the insecticidal activity is increased about 2 fold or greater compared to AXMI-205 (SEQ ID NO: 35).

Embodiment 46 is the PHI-4 polypeptide of any one of embodiments 39-43, wherein the insecticidal activity is increased about 2.5 fold or greater compared to AXMI-205 (SEQ ID NO: 35).

Embodiment 47 is the PHI-4 polypeptide of any one of embodiments 39-43, wherein the insecticidal activity is increased about 3 fold or greater compared to AXMI-205 (SEQ ID NO: 35).

Embodiment 48 is the PHI-4 polypeptide of any one of embodiments 39-43, wherein the insecticidal activity is increased about 5 fold or greater compared to AXMI-205 (SEQ ID NO: 35).

Embodiment 49 is the PHI-4 polypeptide of any one of embodiments 39-48, wherein the improved insecticidal activity compared to AXMI-205 (SEQ ID NO: 35) is against Western Corn Root Worm (WCRW) larvae.

Embodiment 50 is the PHI-4 polypeptide of any one of embodiments 39-49, wherein the improved insecticidal activity compared to AXMI-205 (SEQ ID NO: 35) is quantified as a Mean FAE Index.

Embodiment 51 is the PHI-4 polypeptide of any one of embodiments 39-49, wherein the improved insecticidal activity compared to AXMI-205 (SEQ ID NO: 35) is quantified as an EC50 value.

Embodiment 52 is the PHI-4 polypeptide of any one of embodiments 39-49, wherein the improved activity compared to AXMI-205 (SEQ ID NO: 35) is quantified as a Mean Deviation Score.

Embodiment 53 is the PHI-4 polypeptide of any one of embodiments 39-49, having 1 to 54 amino acid substitutions at a position(s) designated as Xaa in SEQ ID NO: 3 or 4.

Embodiment 54 is the PHI-4 polypeptide of any one of embodiments 39-49, having 1 to 27 amino acid substitutions at a position(s) designated as Xaa in SEQ ID NO: 3 or 4.

Embodiment 55 is the PHI-4 polypeptide of any one of embodiments 39-49, having 1 to 20 amino acid substitutions at a position(s) designated as Xaa in SEQ ID NO: 3 or 4.

Embodiment 56 is the PHI-4 polypeptide of any one of embodiments 39-49, having 1 to 15 amino acid substitutions at a position(s) designated as Xaa in SEQ ID NO: 3 or 4.

Embodiment 57 is the PHI-4 polypeptide of any one of embodiments 1-56, wherein 1-25 amino acids are deleted from the N-terminus of the PHI-4 polypeptide and/or C-terminus of the PHI-4 polypeptide.

Embodiment 58 is the PHI-4 polypeptide of any one of embodiments 1-53, wherein 1-20 amino acids are deleted from the C-terminus of the PHI-4 polypeptide.

Embodiment 59 is a polynucleotide encoding a PHI-4 polypeptide, wherein the PHI-4 polypeptide has improved insecticidal activity compared to AXMI-205 (SEQ ID NO: 35).

Embodiment 60 is the polynucleotide of embodiment 59, wherein the insecticidal activity of the PHI-4 polypeptide is increased about 1.5 fold or greater compared to AXMI-205 (SEQ ID NO: 35).

Embodiment 61 is the polynucleotide of embodiment 59, wherein the insecticidal activity of the PHI-4 polypeptide is increased about 2 fold or greater compared to AXMI-205 (SEQ ID NO: 35).

Embodiment 62 is the polynucleotide of embodiment 59, wherein the insecticidal activity of the PHI-4 polypeptide is increased about 2.5 fold or greater compared to AXMI-205 (SEQ ID NO: 35).

Embodiment 63 is the polynucleotide of embodiment 59, wherein the insecticidal activity of the PHI-4 polypeptide is increased about 3 fold or greater compared to AXMI-205 (SEQ ID NO: 35).

Embodiment 64 is the polynucleotide of embodiment 59, wherein the insecticidal activity of the PHI-4 polypeptide is increased about 5 fold or greater compared to AXMI-205 (SEQ ID NO: 35).

Embodiment 65 is the polynucleotide of any one of embodiments 59-64, wherein the improved insecticidal activity compared to AXMI-205 (SEQ ID NO: 35) is against Western Corn Root Worm (WCRW) larvae.

Embodiment 66 is the polynucleotide of any one of embodiments 59-64, wherein the improved insecticidal activity compared to AXMI-205 (SEQ ID NO: 35) is quantified as a Mean FAE Index.

Embodiment 67 is the polynucleotide of any one of embodiments 59-64, wherein the improved insecticidal activity compared to AXMI-205 (SEQ ID NO: 35) is quantified as an EC50 value.

Embodiment 68 is the polynucleotide of any one of embodiments 59-64, wherein the improved activity compared to AXMI-205 (SEQ ID NO: 35) is quantified as a Mean Deviation Score.

Embodiment 69 is the polynucleotide of any one of embodiments 59-68, wherein the PHI-4 polypeptide comprises one or more amino acid substitutions compared to the native amino acid at position 40, 42, 43, 46, 52, 97, 98, 99, 145, 150, 151, 153, 163, 171, 172, 182, 196, 206, 210, 216, 220, 278, 283, 289, 293, 328, 333, 334, 336, 338, 339, 342, 346, 354, 355, 370, 389, 393, 396, 401, 402, 403, 410, 412, 416, 417, 426, 442, 447, 452, 454, 455, 457, 461, 462, 500, 509, 520 or 527 of SEQ ID NO: 35.

Embodiment 70 is the polynucleotide of any one of embodiments 69, wherein the amino acid at position 40 is Leu or Ile; the amino acid at position 42 is Asp or Asn; the amino acid at position 43 is Phe or Glu; the amino acid at position 46 is Glu or Asn; the amino acid at position 52 is Ile or Val; the amino acid at position 97 is Arg, Asp, Glu or Asn; the amino acid at position 98 is Tyr or Phe; the amino acid at position 99 is Lys or Leu; the amino acid at position 145 is Leu or Val; the amino acid at position 150 is Arg or Gln; the amino acid at position 151 is Asp or Ser; the amino acid at position 153 is Leu or Ile; the amino acid at position 163 is Leu or Val; the amino acid at position 171 is Tyr or Phe; the amino acid at position 172 is Ile or Leu; the amino acid at position 182 is Asp or Gln; the amino acid at position 196 is Gln or Asn; the amino acid at position 206 is Tyr or Phe; the amino acid at position 210 is Val or Ile; the amino acid at position 216 is Glu or Gln; the amino acid at position 220 is Glu, Gln, His or Asp; the amino acid at position 278 is Glu or Asn; the amino acid at position 283 is Ile or Val; the amino acid at position 289 is Lys, Gln or Leu; the amino acid at position 293 is Arg, Gln or Glu; the amino acid at position 328 is Lys or Glu; the amino acid at position 333 is Ser, Lys or Val; the amino acid at position 334 is Gly, Lys or Arg; the amino acid at position 336 is Gly or Ala; the amino acid at position 338 is Ser or Val; the amino acid at position 339 is Glu, Asn or Gln; the amino acid at position 342 is Ala or Ser; the amino acid at position 346 is Pro or Ala; the amino acid at position 354 is Met or Leu; the amino acid at position 355 is Val or Ile; the amino acid at position 370 is His or Arg; the amino acid at position 389 is Trp or Leu; the amino acid at position 393 is Trp or Leu; the amino acid at position 396 is Ala, Leu, Lys, Thr or Gly; the amino acid at position 401 is Ser, His, Gly, Lys or Pro; the amino acid at position 402 is Lys, His, Gly or Trp; the amino acid at position 403 is Asp or Tyr; the amino acid at position 410 is Ile or Val; the amino acid at position 412 is Pro or Ala; the amino acid at position 416 is Arg or Glu; the amino acid at position 417 is Ala or Ser; the amino acid at position 426 is Thr or Ser; the amino acid at position 442 is Gln or Glu; the amino acid at position 447 is Asp or Lys; the amino acid at position 452 is Gln or Lys; the amino acid at position 454 is Arg or Gln; the amino acid at position 455 is Val or Ile; the amino acid at position 457 is Trp or Asn; the amino acid at position 461 is Thr or Ser; the amino acid at position 462 is Gly or Ala; the amino acid at position 500 is Arg or Gln; the amino acid at position 509 is Lys or Gln; the amino acid at position 520 is Lys, Glu or Gln; and the amino acid at position 527 is Gln or Lys.

Embodiment 71 is the polynucleotide of embodiment 69 or 70, wherein the PHI-4 polypeptide further comprises one or more amino acid substitutions compared to the native amino acid at position 86, 359, 464, 465, 466, 467, 468, 499 or 517 of SEQ ID NO: 35.

Embodiment 72 is the polynucleotide of embodiment 71, wherein the amino acid at position 86 is Glu or Thr; the amino acid at position 359 is Gly or Ala; the amino acid at position 464 is Arg, Ala, Lys, Asp or Asn; the amino acid at position 465 is Lys or Met, the amino acid at position 467 is Val, Ala, Leu or Thr; the amino acid at position 468 is Ser or Leu; the amino acid at position 499 is Glu or Ala or the amino acid at position 517 is Glu or Arg.

Embodiment 73 is the polynucleotide of any one of embodiments 59-69 and 72, wherein the PHI-4 polypeptide has 1 to 54 amino acid substitutions compared to SEQ ID NO: 35.

Embodiment 74 is the polynucleotide of any one of embodiments 59-70, wherein the PHI-4 polypeptide has 1 to 27 amino acid substitutions compared to SEQ ID NO: 2.

Embodiment 75 is the polynucleotide of any one of embodiments 59-70, wherein the PHI-4 polypeptide has 1 to 20 amino acid substitutions compared to SEQ ID NO: 35.

Embodiment 76 is the polynucleotide of any one of embodiments 59-70, wherein the PHI-4 polypeptide has 1 to 15 amino acid substitutions compared to SEQ ID NO: 35.

Embodiment 77 is the polynucleotide of embodiments 71 or 72, wherein the PHI-4 polypeptide has 2 to 54 amino acid substitutions compared to SEQ ID NO: 35.

Embodiment 78 is the polynucleotide of embodiments 71 or 72, wherein the PHI-4 polypeptide has 2 to 27 amino acid substitutions compared to SEQ ID NO: 35.

Embodiment 79 is the polynucleotide of embodiments 71 or 72, wherein the PHI-4 polypeptide has 2 to 20 amino acid substitutions compared to SEQ ID NO: 35.

Embodiment 80 is the polynucleotide of embodiments 71 or 72, wherein the PHI-4 polypeptide has 2 to 15 amino acid substitutions compared to SEQ ID NO: 35.

Embodiment 81 is the polynucleotide of any one of embodiments 59-80, wherein the PHI-4 polypeptide has at least 80% identity to SEQ ID NO: 35.

Embodiment 82 is the polynucleotide of any one of embodiments 59-80, wherein the PHI-4 polypeptide has at least 90% identity to SEQ ID NO: 35.

Embodiment 83 is the polynucleotide of any one of embodiments 59-80, wherein the PHI-4 polypeptide has at least 95% identity to SEQ ID NO: 35.

Embodiment 84 is the polynucleotide of any one of embodiments 59-80, wherein the PHI-4 polypeptide has at least 97% identity to SEQ ID NO: 35.

Embodiment 85 is a polynucleotide encoding a PHI-4 polypeptide, wherein the PHI-4 polypeptide has at least one amino acid substitution at a residue relative to SEQ ID NO: 35 in a structural domain selected from:
  a hydrophilic residue;
  a residue in a membrane insertion initiation loop;
  a residue in a receptor binding loop; and
  a residue in a protease sensitive region,
wherein the PHI-4 polypeptide has increased insecticidal activity compared to the polypeptide of SEQ ID NO: 35.

Embodiment 86 is the polynucleotide of embodiment 85, wherein the hydrophilic residues are Asp, Glu, Lys, Arg, His, Ser, Thr, Tyr, Trp, Asn, Gln, and Cys.

Embodiment 87 is the polynucleotide of embodiment 85 or 86, wherein the membrane insertion loops are between about the amino acid at position 92 (Val) and about the amino acid at position 101 (Ala) and between about the amino acid 211 (Gly) and about the amino acid 220 (Glu), relative to SEQ ID NO: 35.

Embodiment 88 is the polynucleotide of embodiment 87, wherein the PHI-4 polypeptide has one or more amino substitution compared to the native amino acid at position 92, 93, 94, 95, 96, 97, 98, 99, 100, 101, 102, 103, 211, 212, 213, 214, 215, 216, 217, 218, 219, and 220 of SEQ ID NO: 35.

Embodiment 89 is the polynucleotide of any one of embodiments 85, 86, 87 or 88, wherein the receptor binding loops are between about the amino acid at position 332 (Asp) and about the amino acid at position 340 (Asp), between about the amino acid at position 395 (Asp) and about the amino acid at position 403 (Asp), and between about the amino acid at position 458 (Asp) and about the amino acid 466 (Asp), relative to SEQ ID NO: 35.

Embodiment 90 is the polynucleotide of embodiment 89, wherein the PHI-4 polypeptide has one or more amino substitution compared to the native amino acid at position 332, 333, 334, 335, 336, 337, 338, 339, 340, 395, 396, 397, 398, 399, 400, 401, 402, 403, 458, 459, 460, 461, 462, 463, 464, 465, 466 of SEQ ID NO: 35.

Embodiment 91 is the polynucleotide of any one of embodiments 85, 86, 87, 88, 89 or 90, wherein the protease sensitive region residue is selected from between about the amino acid at position 305 (Lys) and about the amino acid at position 316 (Lys) and/or between about the amino acid at position 500 (Arg) and about the amino acid at position 535 (Lys) relative to SEQ ID NO: 35.

Embodiment 92 is the polynucleotide of any one of embodiments 85, 86, 87, 88, 89, 90 or 91, wherein the protease is trypsin.

Embodiment 93 is the polynucleotide of any one of embodiments 85-92, wherein the PHI-4 polypeptide has at least 80% sequence identity to SEQ ID NO: 35.

Embodiment 94 is the polynucleotide of any one of embodiments 85-92, wherein the PHI-4 polypeptide has at least 90% sequence identity to SEQ ID NO: 35.

Embodiment 95 is the polynucleotide of any one of embodiments 85-92, wherein the PHI-4 polypeptide has at least 95% sequence identity to SEQ ID NO: 35.

Embodiment 96 is the polynucleotide of any one of embodiments 85-92, wherein the PHI-4 polypeptide has at least 97% sequence identity to SEQ ID NO: 35.

Embodiment 97 is a polynucleotide encoding a PHI-4 polypeptide, wherein the PHI-4 polypeptide comprises an amino acid sequence of the formula,

```
                                              (SEQ ID NO: 3)
                  5                   10
Met Xaa Ser Ala Ala Asn Ala Gly Xaa Leu Gly Asn
         15                  20
Leu Xaa Gly Xaa Thr Ser Xaa Gly Met Xaa Tyr Xaa
25                  30                  35
Val Asn Gly Leu Tyr Ala Ser Pro Glu Ser Leu Xaa
         40                  45
Gly Gln Pro Leu Phe Xaa Xaa Gly Gly Xaa Leu Asp
```

```
            50                  55                  60
Ser Xaa Xaa Ile Glu Gly Xaa Xaa Xaa Xaa Phe Pro
                        65                  70
Xaa Ser Met His Val His Thr Tyr Phe His Ser Asp
            75                  80
Xaa Xaa Gln Xaa Val Ser Xaa Xaa Ile Xaa Xaa Xaa
 85                  90                  95
Arg Xaa Xaa Xaa Ser Xaa His Val Gly Xaa Ser Gly
                100                 105
Xaa Xaa Xaa Leu Phe Ser Xaa Ser Xaa Ser Val Asp
            110                 115                 120
Xaa Thr Thr Xaa Xaa Gln Gln Leu Xaa Glu Ile Thr
                    125                 130
Xaa Ser Ser Thr Arg Glu Xaa His Val Leu Trp Tyr
                135                 140
Ile Ser Leu Pro Gly Ala Ala Thr Leu Xaa Ser Met
145                 150                 155
Leu Xaa Xaa Xaa Xaa Xaa Asp Xaa Xaa Xaa Xaa Pro
                160                 165
Asn Met Xaa Ala Met Xaa Leu Phe Xaa Xaa Xaa Gly
            170                 175                 180
Pro Xaa Xaa Xaa Xaa Xaa Ala Ala Val Gly Gly Arg
                    185                 190
Leu Xaa Xaa Xaa Xaa Ala Ser Lys Xaa Leu Xaa Met
                195                 200
Xaa Ser Ser Xaa Ser Leu Ser Thr Thr Xaa Xaa Xaa
205                 210                 215
Ser Xaa Xaa Ala Xaa Xaa Gly Glu Ile Xaa Ile Xaa
                    220                 225
His Gly Ser Xaa Met Glu Lys Gln Val Asn Ser Phe
            230                 235                 240
Xaa Xaa Xaa Ser Thr Ile Arg Xaa Thr Ala Thr Gly
                    245                 250
Gly Lys Pro Gly Xaa Thr Xaa Arg Ile Leu His Gly
                255                 260
Pro Asp Ser Xaa Xaa Ala Phe Ser Xaa Trp Ala Xaa
265                 270                 275
Ser Leu Leu Xaa Tyr Ala Thr Leu Met Asp Phe Xaa
                    280                 285
Thr Xaa Ser Leu Xaa Xaa Ile Xaa Ala Leu Xaa Asp
            290                 295                 300
Xaa Pro Xaa Xaa Xaa Xaa Glu Xaa Xaa Xaa Ala Xaa
                    305                 310
Pro Xaa Xaa Met Xaa Xaa Ser Gln Xaa Ser Ile Pro
                315                 320
Xaa Val Asp Xaa Val Leu Leu Met Asp Ala Arg Pro
325                 330                 335
Pro Met Val Xaa Ala Gly Xaa Asp Xaa Xaa Xaa Xaa
                340                 345
Xaa Xaa Xaa Asp Xaa Xaa Xaa Xaa Xaa Xaa Ser Thr
            350                 355                 360
Ser Xaa Xaa Tyr Lys Xaa Xaa Gly Gln Phe Xaa Gln
                    365                 370
Arg Xaa His Xaa Ser Val Ala Asp Gly His Xaa Pro
            375                 380
Ile Xaa Xaa Asp Leu Phe Asp Xaa Gly Xaa Xaa Xaa
 385                 390                 395
Xaa Pro Val Gly Xaa Gln Xaa Val Trp Asp Xaa Xaa
                400                 405
Xaa Xaa Gly Lys Xaa Xaa Xaa Tyr Xaa Cys Trp Arg
     410                 415                 420
Xaa Xaa Xaa Xaa Gln Gly Tyr Xaa Xaa Xaa Gly Asp
                425                 430
Val Xaa Met Leu Ala Xaa Ser Gly Tyr Asn Pro Pro
            435                 440
Asn Leu Pro Xaa Xaa Xaa Cys Xaa His Xaa Ser Leu
 445                 450                 455
Xaa Ala Xaa Xaa Xaa Thr Leu Xaa Xaa Xaa Xaa Trp
                460                 465
Xaa Asp Xaa Xaa Xaa Xaa Xaa Xaa Xaa Xaa Val Ser
            470                 475                 480
Leu Trp Xaa Xaa Gly Ala Ala Gly Ala Val Ala Ser
                    485                 490
Ser Cys Phe Ala Gly Val Pro Asn Tyr Asn Asn Pro
            495                 500
Pro Asn Ser Gly Xaa Ile Xaa Xaa Leu Xaa Gly Ser
 505                 510                 515
Ile Ala Cys Val Xaa Thr Ser Ala Ile Ala Ser Met
                520                 525
Xaa Xaa Met Xaa Ser Met Leu Ser Xaa His Xaa Gly
            530                 535
Met Glu Ala Met Met Ser Lys Leu,
``` wherein

Xaa at position 2 is Ala or Arg; Xaa at position 9 is Gln, Lys or Glu; Xaa at position 14 is Pro or Ala; Xaa at position 16 is Val or Asp; Xaa at position 19 is Met or Leu; Xaa at position 22 is Gly or Ser; Xaa at position 24 is Asp, Asn or Gln; Xaa at position 36 is Leu or Met; Xaa at position 42 is Asp, Asn or Gln; Xaa at position 43 is Phe or Glu; Xaa at position 46 is Glu, Asp, Asn or Gly; Xaa at position 50 is Ile or Val; Xaa at position 51 is Glu or Gln; Xaa at position 55 is Arg or Lys; Xaa at position 56 is Ser or Thr; Xaa at position 57 is Tyr or Phe; Xaa at position 58 is Thr or Ser; Xaa at position 61 is Arg, Lys or Glu; Xaa at position 73 is Phe or Tyr; Xaa at position 74 is Lys, Glu, Gly, Arg, Met, Leu, His or Asp; Xaa at position 76 is Asp or Gln; Xaa at position 79 is Lys or Glu; Xaa at position 80 is Glu or Ser; Xaa at position 82 is Glu, Ile, Leu, Tyr or Gln; Xaa at position 83 is Glu or Gln; Xaa at position 84 is Tyr or Phe; Xaa at position 86 is Glu or Gln; Xaa at position 87 is Lys or Gln; Xaa at position 88 is Met, Ile or Leu; Xaa at position 90 is Gln or Glu; Xaa at position 94 is Val or Ile; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile, Met, Phe, Cys, Val or Asn; Xaa at position 103 is Ala or Gly; Xaa at position 105 is Leu or Ile; Xaa at position 109 is Phe, Lys, Gly, Met, Ser, Asp, Asn, Glu, Cys, Ala or Arg; Xaa at position 112 is Thr or Ser; Xaa at position 113 is Asp, Glu or Met; Xaa at position 117 is Thr or Ser; Xaa at position 121 is Tyr or Phe; Xaa at position 127 is Ala or Thr; Xaa at position 142 is Arg or Glu; Xaa at position 146 is Arg or Gln; Xaa at position 147 is Arg, Glu or Gln; Xaa at position 148 is Asp, Phe, Pro, Val, Glu, His, Trp, Ala, Arg, Leu, Ser, Gln or Gly; Xaa at position 149 is Phe or Val; Xaa at position 150 is Arg, Gln, Glu or Asn; Xaa at position 151 is Asp, Ser, Ala, Asn, Trp, Val, Gln, Cys, Met, Leu, Arg or Glu; Xaa at position 153 is Leu or Ile; Xaa at position 154 is Asn or Asp; Xaa at position 155 is Asn or Lys; Xaa at position 159 is Pro or Asp; Xaa at position 162 is Glu, Asp, Gln, Asn or Leu; Xaa at position 165 is Lys, Glu, Gln, Pro, Thr, Ala, Leu, Gly, Asp, Val, His, Ile, Met, Trp, Phe, Tyr or Arg; Xaa at position 166 is Arg or Gln; Xaa at position 167 is Tyr, Trp or Cys; Xaa at position 170 is Tyr or His; Xaa at position 171 is Tyr or Phe; Xaa at position 172 is Ile, Leu or Val; Xaa at position 173 is Ser or Ala; Xaa at position 174 is Glu, Gln, Asn, Lys, Val or Ser; Xaa at position 182 is Asp or Gln; Xaa at position 183 is Tyr or Val; Xaa at position 184 is Ser or Thr; Xaa at position 185 is Ala or Ser; Xaa at position 189 is Thr, Lys or Ile; Xaa at position 191 is Lys or Gln; Xaa at position 193 is Asp or Asn; Xaa at position 196 is Gln, Lys, Asn, Asp, Glu, Ala, Ile or Arg; Xaa at position 202 is Ala or Val; Xaa at position 203 is Glu, Thr or His; Xaa at position 204 is Met or Ala; Xaa at position 206 is Tyr or Phe; Xaa at position 207 is Lys or Gln; Xaa at position 209 is Leu or Pro; Xaa at position 210 is Val or Ile; Xaa at position 214 is Lys, Ser or Gln; Xaa at position 216 is Glu, Gln, Phe, Val, Tyr or Arg; Xaa at position 220 is Glu, His, Asp, Thr, Tyr, Val, Ser, Gln, Arg, Trp, Met, Ala, Phe, Ile, Leu, Cys or Asn; Xaa at position 229 is Arg or Glu; Xaa at position 230 is Ser or Glu; Xaa at position 231 is Asn or Ser; Xaa at position 236 is Leu or Pro; Xaa at position 245 is Met or Leu; Xaa at position 247 is Asp or Tyr; Xaa at position 256 is Gln, Lys or Glu; Xaa at position 257 is Gln, Ile, Glu, Cys, Ser, His, Trp or Met; Xaa at position 261 is Gln, Glu, Lys or Ala; Xaa at position 264 is Glu or Gln; Xaa at position 268 is Asp or Asn; Xaa at position 276 is Ser or Ala; Xaa at position 278 is Glu, Asn or Gln; Xaa at position 281 is Gln, Lys or Glu; Xaa at position 282 is Pro or Gly; Xaa at position 284 is Trp or Arg; Xaa at position 287 is Ala or Cys; Xaa at position 289 is Lys, Leu, Val, Pro, Glu, Gln, Tyr, Thr, Asp, Phe, Ser, Met, Arg, Trp, Ile, His, Asn, Cys, Gly or Ala; Xaa at position 291 is Glu or Gln; Xaa at position 292 is Arg or Gln; Xaa at position 293 is Arg, Glu or Gln; Xaa at position 294 is Val or Ala; Xaa at position 296 is Leu or Ile; Xaa at position 297 is Glu or Gln; Xaa at position 298 is Asp or Gln; Xaa at position 300 is Phe or Tyr; Xaa at position 302 is Glu or Gln; Xaa at position 303 is Phe or Tyr; Xaa at position 305 is Lys, Gln, Ala, Ile, Met, Asn, Thr or Val; Xaa at position 306 is Gln or Lys; Xaa at position 309 is Gln, Lys or Glu; Xaa at position 313 is Lys, Gln or Arg; Xaa at position 316 is Lys or Gln; Xaa at position 328 is Lys, Glu or Gln; Xaa at position 331 is Glu, Asn or Gln; Xaa at position 333 is Ser, Arg, Gly, Lys, Val, Asn, Ala, His, Gln, Thr, Asp, Ile, Leu, Cys or Glu; Xaa at position 334 is Gly, Arg, Lys, Ile or Trp; Xaa at position 335 is Ser or Ala; Xaa at position 336 is Gly or Ala; Xaa at position 337 is Ala, Val or Gly; Xaa at position 338 is Ser, His, Val, Lys, Ala, Gly, Thr, Ile, Glu, Met, Arg, Pro, Asp, Asn or Leu; Xaa at position 339 is Glu, Asn, Gln, Ile, Pro, Met, Ser, Ala, Cys, Phe, Val, Leu, Asp, Trp, His or Arg; Xaa at position 341 is Leu or Val; Xaa at position 342 is Ala, Ser or Val; Xaa at position 343 is Val or Ile; Xaa at position 344 is Phe or Trp; Xaa at position 345 is Asn or His; Xaa at position 346 is Pro or Ala; Xaa at position 350 is Asn or Ser; Xaa at position 351 is Gly or Val; Xaa at position 354 is Met or Leu; Xaa at position 355 is Val, Ile or Leu; Xaa at position 359 is Gly or Ala; Xaa at position 362 is Asn or Ser; Xaa at position 364 is Ala or Ser; Xaa at position 371 is Ala, Gly or Thr; Xaa at position 374 is Phe or Ile; Xaa at position 375 is Lys or Arg; Xaa at position 380 is Leu or Gly; Xaa at position 382 is Val, Asp or Leu; Xaa at position 383 is Leu, Ile or Val; Xaa at position 384 is Lys, Ala or Gly; Xaa at position 385 is Ala or Gly; Xaa at position 389 is Trp or Tyr; Xaa at position 391 is Arg, Leu, Glu, Gln, Asp or His; Xaa at position 395 is Asp or Cys; Xaa at position 396 is Ala, Leu, Lys, Asn, Gly, Ile, Met, Arg, Tyr, Gln, His or Thr; Xaa at position 397 is Gly, Arg or Ala; Xaa at position 398 is Ser, Gln or Cys; Xaa at position 401 is Ser, His, Pro, Gly, Lys, Val, Arg, Ile, Asn, Phe, Thr, Ala, Asp, Met, Gln or Glu; Xaa at position 402 is Lys, Phe, His, Arg, Trp, Gly, Asn, Leu, Tyr, Thr, Val, Met, Pro or Ala; Xaa at position 403 is Asp, Tyr, Trp, Phe or Glu; Xaa at position 405 is Ala or Ser; Xaa at position 409 is Ala or Pro; Xaa at position 410 is Ile or Val; Xaa at position 411 is Pro or Ala; Xaa at position 412 is Pro or Ala; Xaa at position 416 is Arg, Glu or Gln; Xaa at position 417 is Ala, Ser or Cys; Xaa at position 418 is Leu or Met; Xaa at position 422 is Met or Val; Xaa at position 426 is Thr or Ser; Xaa at position 436 is Asp or Lys; Xaa at position 437 is Tyr or Val; Xaa at position 438 is Val or Arg; Xaa at position 440 is Val or Leu; Xaa at position 442 is Gln, Lys or Glu; Xaa at position 445 is Cys, Leu or Thr; Xaa at position 447 is Asp, Lys, Tyr, Ser, Glu, Ile, Gly, Pro, Leu, Phe, Trp or Thr; Xaa at position 448 is Val or Ala; Xaa at position 449 is Gln or Glu; Xaa at position 452 is Gln, Lys or Glu, Ala; Xaa at position 453 is Asn or Asp; Xaa at position 454 is Arg, Tyr, Met, Ser, Val, Ile, Lys, Phe, Trp, Gln, Gly, His, Asp, Leu, Thr, Pro or Asn; Xaa at position 455 is Val or Ile; Xaa at position 457 is Trp or Asn; Xaa at position 459 is Lys, Met, Val, Trp, Gln, Ile, Thr, Ser, His, Cys, Tyr, Pro, Asn, Ala, Arg or Glu; Xaa at position 460 is Gly or Ala; Xaa at position 461 is Thr or Ser; Xaa at position 462 is Gly or Ala; Xaa at position 463 is Ala, Ser or Gly; Xaa at position 464 is Arg, Gly, His, Gln, Thr, Phe, Ala, Asp, Ser or Lys; Xaa at position 465 is Lys, Asn, Val, Met, Pro, Gly, Arg, Thr, His, Cys, Trp, Phe or Leu; Xaa at position 466 is Asp or Arg; Xaa at position 471 is Gln, Lys, Glu or Met; Xaa at position 472 is Pro or Ser; Xaa at position 497 is Asp or Gln; Xaa at position 499 is Glu or Gln; Xaa at position 500 is Arg, Gln or Lys; Xaa at position 502 is Arg, Glu or Gln; Xaa at position 509 is Lys, Gln, Glu or Ala; Xaa at position 517 is Gln, Cys, Asn, Val or Pro; Xaa at position 518 is Glu or Gln; Xaa at position 520 is Lys, Gln, Glu, His or Ala; Xaa at position 525 is Gln or Lys; and Xaa at position 527 is Gln, Lys, Pro, Cys, Glu, Ser, His, Phe or Trp; wherein one or more amino acid(s) designated by Xaa in SEQ ID NO: 3 is an amino acid different from the corresponding amino acid of SEQ ID NO: 35 and wherein the PHI-4 polypeptide has increased insecticidal activity compared to the polypeptide of SEQ ID NO: 35.

Embodiment 98 is a polynucleotide encoding a PHI-4 polypeptide, wherein the PHI-4 polypeptide comprises an amino acid sequence of the formula,

```
                                    (SEQ ID NO: 4)
                5                   10
Met Xaa Ser Ala Ala Asn Ala Gly Gln Leu Gly Asn 15                  20
Leu Pro Gly Val Thr Ser Met Gly Met Gly Tyr Xaa 25                  30                  35
Val Asn Gly Leu Tyr Ala Ser Pro Glu Ser Leu Leu 40                  45
Gly Gln Pro Leu Phe Xaa Xaa Gly Gly Xaa Leu Asp 50                  55                  60
Ser Ile Glu Ile Glu Gly Arg Ser Tyr Thr Phe Pro
```

```
                65                      70
Arg Ser Met His Val His Thr Tyr Phe His Ser Asp 75                  80
Phe Xaa Gln Asp Val Ser Xaa Glu Ile Xaa Glu Tyr 85                  90                  95
Arg Glu Lys Met Ser Gln His Val Gly Val Ser Gly 100                 105
Xaa Xaa Xaa Leu Phe Ser Ala Ser Leu Ser Val Asp 110                 115                 120
Xaa Thr Thr Thr Asp Gln Gln Leu Thr Glu Ile Thr 125                 130
Tyr Ser Ser Thr Arg Glu Ala His Val Leu Trp Tyr 135                 140
Ile Ser Leu Pro Gly Ala Ala Thr Leu Arg Ser Met 145                 150                 155
Leu Arg Xaa Xaa Phe Xaa Xaa Asp Xaa Asn Asn Pro 160                 165
Asn Met Pro Ala Met Xaa Leu Phe Xaa Xaa Tyr Gly 170                 175                 180
Pro Tyr Xaa Ile Ser Xaa Ala Ala Val Gly Gly Arg 185                 190
Leu Xaa Tyr Ser Ala Ala Ser Lys Thr Leu Lys Met 195                 200
Asp Ser Ser Xaa Ser Leu Ser Thr Thr Ala Xaa Met 205                 210                 215
Ser Xaa Lys Ala Leu Val Gly Glu Ile Lys Ile Xaa 220                 225
His Gly Ser Xaa Met Glu Lys Gln Val Asn Ser Phe 230                 235                 240
Arg Ser Asn Ser Thr Ile Arg Leu Thr Ala Thr Gly 245                 250
Gly Lys Pro Gly Met Thr Xaa Arg Ile Leu His Gly 255                 260
Pro Asp Ser Xaa Xaa Ala Phe Ser Xaa Trp Ala Glu 265                 270                 275
Ser Leu Leu Asp Tyr Ala Thr Leu Met Asp Phe Ser 280                 285
Thr Xaa Ser Leu Xaa Pro Ile Trp Ala Leu Ala Asp 290                 295                 300
Xaa Pro Glu Arg Xaa Val Glu Leu Glu Asp Ala Phe 305                 310
Pro Glu Phe Met Lys Gln Ser Gln Gln Ser Ile Pro 315                 320
Xaa Val Asp Lys Val Leu Leu Met Asp Ala Arg Pro 325                 330                 335
Pro Met Val Xaa Ala Gly Glu Asp Xaa Xaa Ser Xaa 340                 345
Ala Xaa Xaa Asp Leu Ala Xaa Phe Asn Xaa Ser Thr 350                 355                 360
Ser Asn Gly Tyr Lys Met Xaa Gly Gln Phe Xaa Gln 365                 370
Arg Asn His Ala Ser Val Ala Asp Gly His Ala Pro 375                 380
Ile Phe Lys Asp Leu Phe Asp Leu Gly Val Leu Lys 385                 390                 395
Ala Pro Val Gly Trp Gln Xaa Val Trp Asp Asp Xaa 400                 405
Gly Ser Gly Lys Xaa Xaa Xaa Tyr Ala Cys Trp Arg 410                 415                 420
Ala Ile Xaa Xaa Gln Gly Tyr Xaa Xaa Xaa Gly Asp 425                 430
Val Met Met Leu Ala Xaa Ser Gly Tyr Asn Pro Pro 435                 440
Asn Leu Pro Asp Tyr Val Cys Xaa His Gln Ser Leu 445                 450                 455
Cys Ala Xaa Val Gln Thr Leu Xaa Asn Xaa Xaa Trp 460                 465
Trp Asp Xaa Gly Xaa Xaa Xaa Xaa Asp Val Ser 470                 475                 480
Leu Trp Xaa Xaa Gly Ala Ala Gly Ala Val Ala Ser 485                 490
Ser Cys Phe Ala Gly Val Pro Asn Tyr Asn Asn Pro 495                 500
Pro Asn Ser Gly Asp Ile Glu Xaa Leu Arg Gly Ser 505                 510                 515
Ile Ala Cys Val Xaa Thr Ser Ala Ile Ala Ser Met 520                 525
Gln Glu Met Xaa Ser Met Leu Ser Gln His Xaa Gly 530                 535
Met Glu Ala Met Met Ser Lys Leu,
``` wherein
Xaa at position 2 is Ala or Arg; Xaa at position 24 is Asp or Asn; Xaa at position 42 is Asp or Asn; Xaa at position 43 is Phe or Glu; Xaa at position 46 is Glu or Asn; Xaa at position 74 is Lys, Glu or Gly; Xaa at position 79 is Lys or Glu; Xaa at position 82 is Glu, Ile, Leu or Tyr; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile or Met; Xaa at position 109 is Phe, Lys, Gly, Met, Ser, Asp or Asn; Xaa at position 147 is Arg or Glu; Xaa at position 148 is Asp, Phe or Pro; Xaa at position 150 is Arg, Gln, Glu or Asn; Xaa at position 151 is Asp, Ser, Ala or Asn; Xaa at position 153 is Leu or Ile; Xaa at position 162 is Glu, Asp, Gln, Asn or Leu; Xaa at position 165 is Lys, Glu or Gln; Xaa at position 166 is Arg or Gln; Xaa at position 171 is Tyr or Phe; Xaa at position 174 is Glu, Gln, Asn, Lys, Val or Ser; Xaa at position 182 is Asp or Gln; Xaa at position 196 is Gln, Lys, Asn or Asp; Xaa at position 203 is Glu, Thr or His; Xaa at position 206 is Tyr or Phe; Xaa at position 216 is Glu or Gln; Xaa at position 220 is Glu, His, Asp, Thr, Tyr, Val, Ser or Gln; Xaa at position 247 is Asp or Tyr; Xaa at position 256 is Gln or Lys; Xaa at position 257 is Gln or Ile; Xaa at position 261 is Gln, Glu, Lys or Ala; Xaa at position 278 is Glu or Asn; Xaa at position 281 is Gln, Lys or Glu; Xaa at position 289 is Lys, Leu, Val, Pro, Glu, Gln, Tyr, Thr or Asp; Xaa at position 293 is Arg, Glu or Gln; Xaa at position 313 is Lys or Gln; Xaa at position 328 is Lys, Glu or Gln; Xaa at position 333 is Ser, Gly, Lys, Val or Asn; Xaa at position 334 is Gly, Arg, Lys or Ile; Xaa at position 336 is Gly or Ala; Xaa at position 338 is Ser, His, Val, Lys or Ala; Xaa at position 339 is Glu, Asn, Ile or Pro; Xaa at position 343 is Val or Ile; Xaa at position 346 is Pro or Ala; Xaa at position 355 is Val or Ile; Xaa at position 359 is Gly or Ala; Xaa at position 391 is Arg, Leu, Glu, Gln, Asp or His; Xaa at position 396 is Ala, Leu, Lys, Asn, Gly or Thr; Xaa at position 401 is Ser, His, Pro, Gly, Lys, Val or Arg; Xaa at position 402 is Lys, Phe, His, Arg, Gly, Trp, Thr, Asn, Tyr or Met; Xaa at position 403 is Asp or Tyr; Xaa at position 411 is Pro or Ala; Xaa at position 412 is Pro or Ala; Xaa at position 416 is Arg or Glu; Xaa at position 417 is Ala or Ser; Xaa at position 418 is Leu or Met; Xaa at position 426 is Thr or Ser; Xaa at position 440 is Val or Leu; Xaa at position 447 is Asp, Lys, Tyr, Ser, Glu or Ile; Xaa at position 452 is Gln, Lys or Glu; Xaa at position 454 is Arg, Tyr, Met, Ser, Val, Ile, Lys, Phe, Trp or Gln; Xaa at position 455 is Val or Ile; Xaa at position 459 is Lys, Met, Val, Trp, Gln, Ile or Tyr; Xaa at position 461 is Thr or Ser; Xaa at position 462 is Gly or Ala; Xaa at position 463 is Ala or Ser; Xaa at position 464 is Arg, Gly, His, Ala, Asp, Ser or Lys; Xaa at position 465 is Lys, Asn, Val, Met, Pro, Gly or Arg; Xaa at position 471 is Gln, Lys, Glu or Met; Xaa at position 472 is Pro or Ser; Xaa at position 500 is Arg or Gln; Xaa at position 509 is Lys, Gln or Ala; Xaa at position 520 is Lys, Gln, Glu, His or Ala; and Xaa at position 527 is Gln, Lys, Pro, Cys or Glu; wherein one or more amino acid(s) designated by Xaa in SEQ ID NO: 4 is an amino acid different from the corresponding amino acid of SEQ ID NO: 35 and wherein the PHI-4 polypeptide has increased insecticidal activity compared to the polypeptide of SEQ ID NO: 35.

Embodiment 99 is the polynucleotide of embodiments 97 or 98, wherein the PHI-4 polypeptide further comprises one or more amino acid substitutions at position 86, 359, 464, 465, 466, 467, 468, 499 or 517 of SEQ ID NO: 3 or SEQ ID NO: 4.

Embodiment 100 is the polynucleotide of embodiment 99, wherein the amino acid at position 86 is Glu or Thr; the amino acid at position 359 is Gly or Ala; the amino acid at position 464 is Arg, Ala, Lys, Asp or Asn; the amino acid at position 465 is Lys or Met, the amino acid at position 467 is Val, Ala, Leu or Thr; the amino acid at position 468 is Ser or Leu; the amino acid at position 499 is Glu or Ala or the amino acid at position 517 is Glu or Arg.

Embodiment 101 is the polynucleotide of any one of embodiments 97-100, wherein the PHI-4 polypeptide further comprises one or more more conservative amino acid substitution, insertion of one or more amino acids, deletion of one or more amino acids, and combinations thereof.

Embodiment 102 is the polynucleotide of any one of embodiments 97-101, wherein the insecticidal activity of the PHI-4 polypeptide is increased about 1.5 fold or greater compared to AXMI-205 (SEQ ID NO: 35).

Embodiment 103 is the polynucleotide of any one of embodiments 97-101, wherein the insecticidal activity of the PHI-4 polypeptide is increased about 2 fold or greater compared to AXMI-205 (SEQ ID NO: 35).

Embodiment 104 is the polynucleotide of any one of embodiments 97-101, wherein the insecticidal activity of the PHI-4 polypeptide is increased about 2.5 fold or greater compared to AXMI-205 (SEQ ID NO: 35).

Embodiment 105 is the polynucleotide of any one of embodiments 97-101, wherein the insecticidal activity of the PHI-4 polypeptide is increased about 3 fold or greater compared to AXMI-205 (SEQ ID NO: 35).

Embodiment 106 is the polynucleotide of any one of embodiments 97-101, wherein the insecticidal activity of the PHI-4 polypeptide is increased about 5 fold or greater compared to AXMI-205 (SEQ ID NO: 35).

Embodiment 107 is the polynucleotide of any one of embodiments 97-106, wherein the improved insecticidal activity compared to AXMI-205 (SEQ ID NO: 35) is against Western Corn Root Worm (WCRW) larvae.

Embodiment 108 is the polynucleotide of any one of embodiments 97-107, wherein the improved insecticidal activity compared to AXMI-205 (SEQ ID NO: 35) is quantified as a Mean FAE Index.

Embodiment 109 is the polynucleotide of any one of embodiments 97-107, wherein the improved insecticidal activity compared to AXMI-205 (SEQ ID NO: 35) is quantified as an EC50 value.

Embodiment 110 is the polynucleotide of any one of embodiments 97-107, wherein the improved activity compared to AXMI-205 (SEQ ID NO: 35) is quantified as a Mean Deviation Score.

Embodiment 111 is the polynucleotide of any one of embodiments 97-110, wherein the PHI-4 polypeptide has 1 to 54 amino acid substitutions at a position(s) designated as Xaa in SEQ ID NO: 3 or SEQ ID NO: 4.

Embodiment 112 is the polynucleotide of any one of embodiments 97-110, wherein the PHI-4 polypeptide has 1 to 27 amino acid substitutions at a position(s) designated as Xaa in SEQ ID NO: 3 or SEQ ID NO: 4.

Embodiment 113 is the polynucleotide of any one of embodiments 97-110, wherein the PHI-4 polypeptide has 1 to 20 amino acid substitutions at a position(s) designated as Xaa in SEQ ID NO: 3 or SEQ ID NO: 4.

Embodiment 114 is the polynucleotide of any one of embodiments 97-110, wherein the PHI-4 polypeptide has 1 to 15 amino acid substitutions at a position(s) designated as Xaa in SEQ ID NO: 3 or SEQ ID NO: 4.

Embodiment 115 is the polynucleotide of any one of embodiments 97-114, wherein 1-25 amino acids are deleted from the N-terminus of the PHI-4 polypeptide and/or C-terminus of the PHI-4 polypeptide.

Embodiment 116 is the polynucleotide of any one of embodiments 97-114, wherein 1-20 amino acids are deleted from the C-terminus of the PHI-4 polypeptide.

Embodiment 117 is a composition, comprising an insecticidally-effective amount of the PHI-4 polypeptide of any one of embodiments 1-58.

Embodiment 118 is a method of inhibiting growth or killing an insect pest, comprising contacting the insect pest with the composition of embodiment 117.

Embodiment 119 is a method for controlling an insect pest population resistant to a pesticidal protein, comprising contacting the resistant insect pest population with the composition of embodiment 117.

Embodiment 120 is the method of controlling an insect pest population resistant to an pesticidal protein of embodiment 119, wherein the pesticidal protein is selected from Cry1Ac, Cry1Ab, Cry1A.105, Cry1Ac, Cry1F, Cry1Fa2, Cry1F, Cry2Ab, Cry3A, mCry3A, Cry3Bb1, Cry34Ab1, Cry35Ab1, Vip3A, Cry9c, eCry3.1Ab and CBI-Bt.

Embodiment 121 is a transgenic plant or progeny thereof, comprising the polynucleotide of any one of embodiments 59-116. Embodiment 122 is the transgenic plant or progeny thereof of embodiment 121, wherein the transgenic plant is a monocotyledon.

Embodiment 123 is the transgenic plant or progeny thereof of embodiment 122, wherein the plant is selected from barley, corn, oat, rice, rye, sorghum, turf grass, sugarcane, wheat, alfalfa, banana, broccoli, bean, cabbage, canola, carrot, cassava, cauliflower, celery, citrus, cotton, a cucurbit, *eucalyptus*, flax, garlic, grape, onion, lettuce, pea, peanut, pepper, potato, poplar, pine, sunflower, safflower, soybean, strawberry, sugar beet, sweet potato, tobacco, tomato ornamental, shrub, nut, chickpea, pigeon pea, millets, hops and pasture grasses.

Embodiment 124 is the transgenic plant or progeny thereof of embodiment 123, further comprising one or more additional transgenic traits.

Embodiment 125 is the transgenic plant of embodiment 124, wherein the one or more additional transgenic trait is selected from insect resistance, herbicide resistance, fungal resistance, viral resistance, stress tolerance, disease resistance, male sterility, stalk strength, increased yield, modified starches, improved oil profile, balanced amino acids, high lysine or methionine, increased digestibility, improved fiber quality, flowering, ear and seed development, enhancement of nitrogen utilization efficiency, altered nitrogen responsiveness, drought resistance or tolerance, cold resistance or tolerance, salt resistance or tolerance and increased yield under stress.

Embodiment 126 is seed, grain or processed product thereof of the transgenic plant of any one of embodiments 121-126, wherein the seed, grain or processed product thereof comprises the polynucleotide of any one of embodiments 121-125.

Embodiment 127 is an expression cassette, comprising the polynucleotide of any one of embodiments 59-116 operably linked to one or more regulatory sequences directing expression of the PHI-4 polypeptide.

Embodiment 128 is a transgenic plant or plant cell, comprising the expression cassette of embodiment 127.

Embodiment 129 is seed, grain or processed product thereof of the transgenic plant of embodiment 128, wherein the seed, grain or processed product thereof comprises the recombinant nucleic acid molecule of embodiment of 1 and the recombinant nucleic acid molecule of 24.

Embodiment 130 is the seed of embodiment 129, wherein one or more seed treatment has been applied to the seed.

Embodiment 131 is a method for expressing in a plant a polynucleotide encoding an insecticidal protein, comprising
(a) inserting into a plant cell the polynucleotide of any one of embodiment 59-116 encoding the PHI-4 polypeptide;
(b) obtaining a transformed plant cell comprising the nucleic acid sequence of step (a); and
(c) generating from the transformed plant cell a plant capable of expressing the polynucleotide encoding the PHI-4 polypeptide.

Embodiment 132 is a method for protecting a plant from an insect pest, comprising expressing in the plant or cell thereof, an insecticidally-effective amount of the PHI-4 polypeptide of any one of embodiments 1-58.

Embodiment 133 is a method for controlling an insect pest population, comprising contacting the insect pest population with an insecticidally-effective amount of the PHI-4 polypeptide of any one of embodiments 1-58.

Embodiment 134 is a method of inhibiting growth or killing an insect pest, comprising contacting the insect pest with a composition comprising an insecticidally-effective amount of the the PHI-4 polypeptide of any one of embodiments 1-58.

Embodiment 135 is a method for controlling an insect pest population resistant to a pesticidal protein, comprising contacting the insect pest population with an insecticidally-effective amount of the PHI-4 polypeptide of any one of embodiments 1-58.

Embodiment 136 is a fusion protein comprising the PHI-4 polypeptide of any one of embodiments 1-58.

Embodiment 137 is a fusion protein comprising the PHI-4 polypeptide of any one of embodiments 1-58 and a maltose binding protein.

Embodiment 138 is the fusion protein of embodiment 137, wherein the maltose binding protein has an amino acid sequence of SEQ ID NO: 1516 or SEQ ID NO: 1517.

BRIEF DESCRIPTION OF THE FIGURES

FIG. 1 shows FAE analysis of MPB::PHI-4-SFR12-004 (SEQ ID NO: 31). The reference protein is MBP::PHI-4 polypeptide of (SEQ ID NO: 6). The % Response is given on the y axis. The dose of the toxin fragment is given on the x axis in parts per million (ppm). Half dose (+) and full dose (*) indicate a mean response from six replicate wells at the indicated concentration. All data are from a single experiment.

FIG. 2 shows EC50 analysis of MBP::PHI-4 polypeptide of SEQ ID NO: 6 and MPB::PHI-4-SFR12-004 (SEQ ID NO: 35). The % Response is given on the y axis. The dose of the toxin fragment is given on the x axis in parts per million (ppm). The % Response is given on the y axis. The dose of the toxin fragment is given on the x axis in parts per million (ppm). The protein concentration (toxin portion of the protein only) is given on the x axis. Each symbol indicates a mean response from twenty-four replicate wells at the indicated concentration. All data are from a single experiment. triangles: MBP::PHI-4 (SEQ ID NO: 6); circles: MBP::PHI-4-SFR12-004 (SEQ ID NO: 31).

FIG. 3 shows the amino acids sequence of the C-terminal portion of the PHI-4 polypeptide (SEQ ID NO: 2) is given. Three stretches of sequence corresponding to nine amino acid motifs that align to the putative sugar binding loop motif D-X-G-(SIT)-G-$X_3$-D (SEQ ID NO: 40) are highlighted in grey.

FIG. 4 shows EC50 data for SEQ ID NO: 610, SEQ ID NO: 595, SEQ ID NO: 584, SEQ ID NO: 591, SEQ ID NO: 576, SEQ ID NO: 73, SEQ ID NO: 74, SEQ ID NO: 75, SEQ ID NO: 79, SEQ ID NO: 81, SEQ ID NO: 150, SEQ ID NO: 150, SEQ ID NO: 149, SEQ ID NO: 167, SEQ ID NO: 167, SEQ ID NO: 164, SEQ ID NO: 164, SEQ ID NO: 170, SEQ ID NO: 170, SEQ ID NO: 795, SEQ ID NO: 794, SEQ ID NO: 784, SEQ ID NO: 799, SEQ ID NO: 785, SEQ ID NO: 788, SEQ ID NO: 786, SEQ ID NO: 796, SEQ ID NO: 787. The x-axis corresponds to the mean fold improvement in EC50, relative to MBP::PHI-4 fusion (SEQ ID NO: 6) from at least three independent EC50 measurements. The y-axis corresponds to the mean fold improvement of the mean FAE Index from at least three independent measurements.

FIG. 5. T0 seedlings in the V3-V4 growth stage were challenged as described (Oleson J. et al *J. Economic Entomology* 98:1-8; 2005) and root nodal injury scores were recorded. The groups indicated along the x axis were either controls or were transformed with a plant vector of Example 18: 1—untransformed control; 2—positive control transgenic expressing positive control protein; 3—AXMI-205 polypeptide (SEQ ID NO: 22); 4—PHI-4-B09 polypeptide (SEQ ID NO: 23); 5—PHI-4-D09 polypeptide (SEQ ID NO: 24); 6—PHI-4-H08 polypeptide (SEQ ID NO: 25).

DETAILED DESCRIPTION

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with a nucleic acid sequence encoding a PHI-4 polypeptide. In particular, the nucleic acid sequences of the embodiments are useful for preparing plants and microorganisms possessing pesticidal activity. Thus, transformed bacteria, plants, plant cells, plant tissues and seeds are provided. Compositions are pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered PHI-4 polypeptides by methods known in the art, such as site directed mutagenesis, domain swapping or DNA shuffling. The PHI-4 polypeptides find use in controlling, inhibiting growth or killing Lepidopteran, Coleopteran, Dipteran, fungal, Hemipteran, and nematode pest populations and for producing compositions with pesticidal activity. Insect pests of interest include, but are not limited to, the superfamily of stink bugs and other related insects including, but not limited to, species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (*Bagrada* Bug)), the family Plataspidae (*Megacopta cribraria*-Bean plataspid), and the family Cydnidae (*Scaptocoris castanea*-Root stink bug) and *Lepidoptera* species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

By "pesticidal toxin" or "pesticidal protein" is intended a toxin that has toxic activity against one or more pests, including, but not limited to, members of the *Lepidoptera, Diptera, Hemiptera* and *Coleoptera* orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin, (2011) *PLoS Pathogens*, 7:1-13) from *Pseudomonas protegens* strain CHA0 and Pf-5 (previously *fluorescens*) (Pechy-Tarr, (2008) *Environmental Microbiology* 10:2368-2386: GenBank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. No. 6,048,838, and U.S. Pat. No. 6,379,946; and δ-endotoxins including, but not limited to, the cry1, cry2, cry3, cry4, cry5, cry6, cry7, cry8, cry9, cry10, cry11, cry12, cry13, cry14, cry15, cry16, cry17, cry18, cry19, cry20, cry21, cry22, cry23, cry24, cry25, cry26, cry27, cry 28, cry 29, cry 30, cry31, cry32, cry33, cry34, cry35, cry36, cry37, cry38, cry39, cry40, cry41, cry42, cry43, cry44, cry45, cry 46, cry47, cry49, cry 51, cry 52, cry 53, cry54, cry55, cry56, cry57, cry58, cry59, cry60, cry61, cry62, cry63, cry64, cry65, cry66, cry67, cry68, cry69, cry70, cry71, cry72, and cry73 classes of δ-endotoxin genes and the *B. thuringiensis* cytolytic cyt1 and cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession #126149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession #112419); Cry1Ab12 (Accession # AAC64003); Cry1Ab13 (Accession # AAN76494); Cry1Ab14 (Accession # AAG16877); Cry1Ab15 (Accession # AA013302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession #112418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession #

FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1 Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession #176415); Cry1Da3 (Accession # HQ439784); Cry1 Db1 (Accession # CAA80234); Cry1 Db2 (Accession # AAK48937); Cry1Dc1 (Accession # ABK35074); Cry1Ea1 (Accession # CAA37933); Cry1Ea2 (Accession # CAA39609); Cry1 Ea3 (Accession # AAA22345); Cry1 Ea4 (Accession # AAD04732); Cry1 Ea5 (Accession # A15535); Cry1 Ea6 (Accession # AAL50330); Cry1 Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # AB183671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession

JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # AB030519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession #115475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession #134543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # AC144005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3

(Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession #132932); Cry21Aa2 (Accession #166477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession #134547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # AC122625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BA144026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BA144022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EA057254); Cry60Aa3 (Accession # EEM99278); Cry60Ba1 (Accession # GU810818); Cry60Ba2 (Accession # EA057253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509);

Cry63Aa1 (Accession # BAI44028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569); and Cry73Aa (Accession # AEH76822); Cyt1Aa (GenBank Accession # X03182), Cyt1Ab (GenBank Accession # X98793), Cyt1B (GenBank Accession # U37196), Cyt2A (GenBank Accession # Z14147), Cyt2B (GenBank Accession # U52043).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of cry proteins such as Cry1A, Cry3A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US20090144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI257, AXMI1268, AXMI127, AXMI129, AXMI164, AXMI151, AXMI161, AXMI183, AXMI132, AXMI138, AXMI137 of US 2010/0005543; cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/ Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/ index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615, 686, and 8,237,020 and the like. Other VIP proteins are well known to one skilled in the art (see, lifesci.sussex.ac.uk/ home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

In some embodiments the PHI-4 polypeptides include amino acid sequences deduced from the full-length nucleic acid sequences disclosed herein, and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of PHI-4 polypeptides. The protein resulting from translation of these PHI-4 polypeptide genes allows cells to control or kill pests that ingest it.

Nucleic Acid Molecules, and Variants and Fragments Thereof

One aspect pertains to isolated or recombinant nucleic acid molecules comprising nucleic acid sequences encoding PHI-4 polypeptides and polypeptides or biologically active portions thereof, as well as nucleic acid molecules sufficient for use as hybridization probes to identify nucleic acid molecules encoding proteins with regions of sequence homology. As used herein, the term "nucleic acid molecule" is intended to include DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding a PHI-4 polypeptide can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments a nucleic acid molecule encoding the PHI-4 polypeptide is a non-genomic nucleic acid sequence. As used herein a "non-genomic nucleic acid sequence" or "non-genomic nucleic acid molecule" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

A variety of polynucleotides encoding a PHI-4 polypeptide(s) or related proteins are contemplated. Such polynucleotides are useful for production of PHI-4 polypeptides in host cells when operably linked to suitable promoter, transcription termination and/or polyadenylation sequences. Such polynucleotides are also useful as probes for isolating homologous or substantially homologous polynucleotides encoding PHI-4 polypeptides or related proteins.

The present disclosure provides isolated or recombinant polynucleotides that encode any of the PHI-4 polypeptides disclosed herein. Those having ordinary skill in the art will readily appreciate that due to the degeneracy of the genetic code, a multitude of nucleotide sequences encoding β-glucosidase polypeptides of the present disclosure exist. Table 1 is a Codon Table that provides the synonymous codons for each amino acid. For example, the codons AGA, AGG, CGA, CGC, CGG, and CGU all encode the amino acid arginine. Thus, at every position in the nucleic acids of the disclosure where an arginine is specified by a codon, the codon can be altered to any of the corresponding codons described above without altering the encoded polypeptide. It is understood that U in an RNA sequence corresponds to T in a DNA sequence.

TABLE 1

| | | | |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |

TABLE 1-continued

| | | | |
|---|---|---|---|
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

Such "silent variations" are one species of "conservative" variation. One of ordinary skill in the art will recognize that each codon in a nucleic acid (except AUG, which is ordinarily the only codon for methionine) can be modified by standard techniques to encode a functionally identical polypeptide. Accordingly, each silent variation of a nucleic acid which encodes a polypeptide is implicit in any described sequence. The disclosure contemplates and provides each and every possible variation of nucleic acid sequence encoding a polypeptide of the disclosure that could be made by selecting combinations based on possible codon choices. These combinations are made in accordance with the standard triplet genetic code (set forth in Table 1), as applied to the polynucleotide sequences of the present disclosure.

A group of two or more different codons that, when translated in the same context, all encode the same amino acid, are referred to herein as "synonymous codons." Polynucleotides encoding PHI-4 polypeptides of the present disclosure may be codon optimized for expression in a particular host organism by modifying the polynucleotides to conform with the optimum codon usage of the desired host organism. Those having ordinary skill in the art will recognize that tables and other references providing preference information for a wide range of organisms are readily available.

Polynucleotides encoding a PHI-4 polypeptide can also be synthesized de novo from a PHI-4 polypeptide sequence. The sequence of the polynucleotide gene can be deduced from a PHI-4 polypeptide sequence through use of the genetic code. Computer programs such as "BackTranslate" (GCG™ Package, Acclerys, Inc. San Diego, Calif.) can be used to convert a peptide sequence to the corresponding nucleotide sequence encoding the peptide. Examples of PHI-4 polypeptide sequences that can be used to obtain corresponding nucleotide encoding sequences include, but are not limited to, the PHI-4 polypeptide sequence of SEQ ID NO: 2, SEQ ID NO: 3, SEQ ID NO: 4, SEQ ID NOs: 51-1162, and SEQ ID NOs: 1518-1526. Furthermore, synthetic PHI-4 polynucleotide sequences of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding a PHI-4 polypeptide is a polynucleotide having the sequence set forth in SEQ ID NO: 1, SEQ ID NO: 7, SEQ ID NO: 11, SEQ ID NOs: 24-30, SEQ ID NOs: 1163-1505 and variants, fragments and complements thereof. By "complement" is intended a nucleic acid sequence that is sufficiently complementary to a given nucleic acid sequence such that it can hybridize to the given nucleic acid sequence to thereby form a stable duplex. In some embodiments the nucleic acid molecule encoding a PHI-4 polypeptide is a nucleic acid molecule having the sequence set forth in SEQ ID NO: 1, SEQ ID NO: 7, SEQ ID NO: 11, SEQ ID NOs: 24-30 and SEQ ID NOs: 1163-1505. The corresponding amino acid sequences for the insecticidal protein encoded by these nucleic acid sequences are set forth in SEQ ID NO: 1, SEQ ID NO: 7, SEQ ID NO: 11, SEQ ID NOs: 24-30 and SEQ ID NOs: 1163-1505.

In some embodiments the nucleic acid molecule encoding a PHI-4 polypeptide is a polynucleotide having a nucleotide sequence encoding a polypeptide comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or greater sequence identity to the amino acid sequence of SEQ ID NO: 35, wherein the polypeptide has pesticidal activity. In some embodiments the nucleic acid molecule encoding a PHI-4 polypeptide is a polynucleotide having a nucleotide sequence encoding a polypeptide comprising an amino acid sequence having 80% and 95% identity, to the amino acid sequence of SEQ ID NO: 35, wherein the polypeptide has pesticidal activity.

In some embodiments the nucleic acid molecule encoding a PHI-4 polypeptide is a polynucleotide having a nucleotide sequence encoding a polypeptide comprising an amino acid sequence having at least 80% identity, to any one of the amino acid sequence of SEQ ID NOs: 51-1162 SEQ ID NOs: 1518-1526 wherein the polypeptide has pesticidal activity.

In some embodiments the nucleic acid molecule encoding a PHI-4 polypeptide is a polynucleotide having a nucleotide sequence encoding a polypeptide comprising an amino acid sequence of SEQ ID NO: 3, wherein Xaa at position 2 is Ala or Arg; Xaa at position 9 is Gln, Lys or Glu; Xaa at position 14 is Pro or Ala; Xaa at position 16 is Val or Asp; Xaa at position 19 is Met or Leu; Xaa at position 22 is Gly or Ser; Xaa at position 24 is Asp, Asn or Gln; Xaa at position 36 is Leu or Met; Xaa at position 42 is Asp, Asn or Gln; Xaa at position 43 is Phe or Glu; Xaa at position 46 is Glu, Asp, Asn or Gly; Xaa at position 50 is Ile or Val; Xaa at position 51 is Glu or Gln; Xaa at position 55 is Arg or Lys; Xaa at position 56 is Ser or Thr; Xaa at position 57 is Tyr or Phe; Xaa at position 58 is Thr or Ser; Xaa at position 61 is Arg, Lys or Glu; Xaa at position 73 is Phe or Tyr; Xaa at position 74 is Lys, Glu, Gly, Arg, Met, Leu, His or Asp; Xaa at position 76 is Asp or Gln; Xaa at position 79 is Lys or Glu; Xaa at position 80 is Glu or Ser; Xaa at position 82 is Glu, Ile, Leu, Tyr or Gln; Xaa at position 83 is Glu or Gln; Xaa at position 84 is Tyr or Phe; Xaa at position 86 is Glu or Gln; Xaa at position 87 is Lys or Gln; Xaa at position 88 is Met, Ile or Leu; Xaa at position 90 is Gln or Glu; Xaa at position 94 is Val or Ile; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile, Met, Phe, Cys, Val or Asn; Xaa at position 103 is Ala or Gly; Xaa at position 105 is Leu or Ile; Xaa at position 109 is Phe, Lys, Gly, Met, Ser, Asp, Asn, Glu, Cys, Ala or Arg; Xaa at position 112 is Thr or Ser; Xaa at position 113 is Asp, Glu or Met; Xaa at position 117 is Thr or Ser; Xaa at position 121 is Tyr or Phe; Xaa at position 127 is Ala or Thr; Xaa at position 142 is Arg or Glu; Xaa at position 146 is Arg or Gln; Xaa at position 147 is Arg, Glu or Gln; Xaa at position 148 is Asp, Phe, Pro, Val, Glu, His, Trp, Ala, Arg, Leu, Ser, Gln or Gly; Xaa at position 149 is Phe or Val; Xaa at position 150 is Arg, Gln, Glu or Asn; Xaa at position 151 is Asp, Ser, Ala, Asn, Trp, Val, Gln, Cys, Met, Leu, Arg or Glu; Xaa at position 153 is Leu or Ile; Xaa at position 154 is Asn or Asp; Xaa at position 155 is Asn or Lys; Xaa at position 159 is Pro or Asp; Xaa at position 162 is Glu, Asp, Gln, Asn or Leu; Xaa at position 165 is Lys, Glu, Gln, Pro, Thr, Ala, Leu, Gly, Asp, Val, His, Ile, Met, Trp, Phe, Tyr or Arg; Xaa at position 166 is Arg or Gln; Xaa at position 167 is Tyr, Trp or Cys; Xaa at position 170 is Tyr or His; Xaa at position 171 is Tyr or Phe; Xaa at position 172 is Ile, Leu or Val; Xaa at position 173 is Ser or Ala; Xaa at position 174 is Glu, Gln, Asn, Lys, Val or Ser; Xaa at position 182 is Asp or Gln; Xaa at position 183 is Tyr or Val; Xaa at position 184 is Ser or Thr; Xaa at position 185 is Ala or Ser; Xaa at position 189 is Thr, Lys or Ile; Xaa at position 191 is Lys or Gln; Xaa at position 193 is Asp or Asn; Xaa at position 196 is Gln, Lys, Asn, Asp, Glu, Ala, Ile or Arg; Xaa at position 202 is Ala or Val; Xaa at position 203 is Glu, Thr or His; Xaa at position 204 is Met or Ala; Xaa at position 206 is Tyr or Phe; Xaa at position 207 is Lys or Gln; Xaa at position 209 is Leu or Pro; Xaa at position 210 is Val or Ile; Xaa at position 214 is Lys, Ser or Gln; Xaa at position 216 is Glu, Gln, Phe, Val, Tyr or Arg; Xaa at position 220 is Glu, His, Asp, Thr, Tyr, Val, Ser, Gln, Arg, Trp, Met, Ala, Phe, Ile, Leu, Cys or Asn; Xaa at position 229 is Arg or Glu; Xaa at position 230 is Ser or Glu; Xaa at position 231 is Asn or Ser; Xaa at position 236 is Leu or Pro; Xaa at position 245 is Met or Leu; Xaa at position 247 is Asp or Tyr; Xaa at position 256 is Gln, Lys or Glu; Xaa at position 257 is Gln, Ile, Glu, Cys, Ser, His, Trp or Met; Xaa at position 261 is Gln, Glu, Lys or Ala; Xaa at position 264 is Glu or Gln; Xaa at position 268 is Asp or Asn; Xaa at position 276 is Ser or Ala; Xaa at position 278 is Glu, Asn or Gln; Xaa at position 281 is Gln, Lys or Glu; Xaa at position 282 is Pro or Gly; Xaa at position 284 is Trp or Arg; Xaa at position 287 is Ala or Cys; Xaa at position 289 is Lys, Leu, Val, Pro, Glu, Gln, Tyr, Thr, Asp, Phe, Ser, Met, Arg, Trp, Ile, His, Asn, Cys, Gly or Ala; Xaa at position 291 is Glu or Gln; Xaa at position 292 is Arg or Gln; Xaa at position 293 is Arg, Glu or Gln; Xaa at position 294 is Val or Ala; Xaa at position 296 is Leu or Ile; Xaa at position 297 is Glu or Gln; Xaa at position 298 is Asp or Gln; Xaa at position 300 is Phe or Tyr; Xaa at position 302 is Glu or Gln; Xaa at position 303 is Phe or Tyr; Xaa at position 305 is Lys, Gln, Ala, Ile, Met, Asn, Thr or Val; Xaa at position 306 is Gln or Lys; Xaa at position 309 is Gln, Lys or Glu; Xaa at position 313 is Lys, Gln or Arg; Xaa at position 316 is Lys or Gln; Xaa at position 328 is Lys, Glu or Gln; Xaa at position 331 is Glu, Asn or Gln; Xaa at position 333 is Ser, Arg, Gly, Lys, Val, Asn, Ala, His, Gln, Thr, Asp, Ile, Leu, Cys or Glu; Xaa at position 334 is Gly, Arg, Lys, Ile or Trp; Xaa at position 335 is Ser or Ala; Xaa at position 336 is Gly or Ala; Xaa at position 337 is Ala, Val or Gly; Xaa at position 338 is Ser, His, Val, Lys, Ala, Gly, Thr, Ile, Glu, Met, Arg, Pro, Asp, Asn or Leu; Xaa at position 339 is Glu, Asn, Gln, Ile, Pro, Met, Ser, Ala, Cys, Phe, Val, Leu, Asp, Trp, His or Arg; Xaa at position 341 is Leu or Val; Xaa at position 342 is Ala, Ser or Val; Xaa at position 343 is Val or Ile; Xaa at position 344 is Phe or Trp; Xaa at position 345 is Asn or His; Xaa at position 346 is Pro or Ala; Xaa at position 350 is Asn or Ser; Xaa at position 351 is Gly or Val; Xaa at position 354 is Met or Leu; Xaa at position 355 is Val, Ile or Leu; Xaa at position 359 is Gly or Ala; Xaa at position 362 is Asn or Ser; Xaa at position 364 is Ala or Ser; Xaa at position 371 is Ala, Gly or Thr; Xaa at position 374 is Phe or Ile; Xaa at position 375 is Lys or Arg; Xaa at position 380 is Leu or Gly; Xaa at position 382 is Val, Asp or Leu; Xaa at position 383 is Leu, Ile or Val; Xaa at position 384 is Lys, Ala or Gly; Xaa at position 385 is Ala or Gly; Xaa at position 389 is Trp or Tyr; Xaa at position 391 is Arg, Leu, Glu, Gln, Asp or His; Xaa at position 395 is Asp or Cys; Xaa at position 396 is Ala, Leu, Lys, Asn, Gly, Ile, Met, Arg, Tyr, Gln, His or Thr; Xaa at position 397 is Gly, Arg or Ala; Xaa at position 398 is Ser, Gln or Cys; Xaa at position 401 is Ser, His, Pro, Gly, Lys, Val, Arg, Ile, Asn, Phe, Thr, Ala, Asp, Met, Gln or Glu; Xaa at position 402 is Lys, Phe, His, Arg, Trp, Gly, Asn, Leu, Tyr, Thr, Val, Met, Pro or Ala; Xaa at position 403 is Asp, Tyr, Trp, Phe or Glu; Xaa at position 405 is Ala or Ser; Xaa at position 409 is Ala or Pro; Xaa at position 410 is Ile or Val; Xaa at position 411 is Pro or Ala; Xaa at position 412 is Pro or Ala; Xaa at position 416 is Arg, Glu or Gln; Xaa at position 417 is Ala, Ser or Cys; Xaa at position 418 is Leu or Met; Xaa at position 422 is Met or Val; Xaa at position 426 is Thr or Ser; Xaa at position 436 is Asp or Lys; Xaa at position 437 is Tyr or Val; Xaa at position 438 is Val or Arg; Xaa at position 440 is Val or Leu; Xaa at position 442 is Gln, Lys or Glu; Xaa at position 445 is Cys, Leu or Thr; Xaa at position 447 is Asp, Lys, Tyr, Ser, Glu, Ile, Gly, Pro, Leu, Phe, Trp or Thr; Xaa at position 448 is Val or Ala; Xaa at position 449 is Gln or Glu; Xaa at position 452 is Gln, Lys or Glu, Ala; Xaa at position 453 is Asn or Asp; Xaa at position 454 is Arg, Tyr, Met, Ser, Val, Ile, Lys, Phe, Trp, Gln, Gly, His, Asp, Leu, Thr, Pro or Asn; Xaa at position 455 is Val or Ile; Xaa at position 457 is Trp or Asn; Xaa at position 459 is Lys, Met, Val, Trp, Gln, Ile, Thr, Ser, His, Cys, Tyr, Pro, Asn, Ala, Arg or Glu; Xaa at position 460 is Gly or Ala; Xaa at position 461 is Thr or Ser; Xaa at position 462 is Gly or Ala; Xaa at position 463 is Ala, Ser or Gly; Xaa at position 464 is Arg, Gly, His, Gln, Thr, Phe, Ala, Asp, Ser or Lys; Xaa at position 465 is Lys, Asn, Val, Met, Pro, Gly, Arg, Thr, His, Cys, Trp, Phe or Leu; Xaa at position 466 is Asp or Arg; Xaa at position 471 is Gln, Lys, Glu or Met; Xaa at position 472 is Pro or Ser; Xaa at position 497 is Asp or Gln; Xaa at position 499 is Glu or Gln; Xaa at position 500 is Arg, Gln or Lys; Xaa at position 502 is Arg, Glu or Gln; Xaa at position 509 is Lys, Gln, Glu or Ala; Xaa at position 517 is Gln, Cys, Asn, Val or Pro; Xaa at position 518 is Glu or Gln; Xaa at position 520 is Lys, Gln, Glu, His or Ala; Xaa at position 525 is Gln or Lys; and Xaa at position 527 is Gln, Lys, Pro, Cys, Glu, Ser, His, Phe or Trp; and having one or more amino acid substitutions at positions designated as Xaa in SEQ ID NO: 3 and wherein the PHI-4 polypeptide has increased insecticidal activity compared to the polypeptide of SEQ ID NO: 35.

In some embodiments the nucleic acid molecule encoding a PHI-4 polypeptide is a polynucleotide having a nucleotide sequence encoding a polypeptide comprising an amino acid sequence of SEQ ID NO: 4, wherein Xaa at position 2 is Ala or Arg; Xaa at position 24 is Asp or Asn; Xaa at position 42 is Asp or Asn; Xaa at position 43 is Phe or Glu; Xaa at position 46 is Glu or Asn; Xaa at position 74 is Lys, Glu or Gly; Xaa at position 79 is Lys or Glu; Xaa at position 82 is Glu, Ile, Leu or Tyr; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile or Met; Xaa at position 109 is Phe, Lys, Gly, Met, Ser, Asp or Asn; Xaa at position 147 is Arg or Glu; Xaa at position 148 is Asp, Phe or Pro; Xaa at position 150 is Arg, Gln, Glu or Asn; Xaa at position 151 is Asp, Ser, Ala or Asn; Xaa at position 153 is Leu or Ile; Xaa at position 162 is Glu, Asp, Gln, Asn or Leu; Xaa at position 165 is Lys, Glu or Gln; Xaa at position 166 is Arg or Gln; Xaa at position 171 is Tyr or Phe; Xaa at position 174 is Glu, Gln, Asn, Lys, Val or Ser; Xaa at position 182 is Asp or Gln; Xaa at position 196 is Gln, Lys, Asn or Asp; Xaa at position 203 is Glu, Thr or His; Xaa at position 206 is Tyr or Phe; Xaa at position 216 is Glu or Gln; Xaa at position 220 is Glu, His, Asp, Thr, Tyr, Val, Ser or Gln; Xaa at position 247 is Asp or Tyr; Xaa at position 256 is Gln or Lys; Xaa at position 257 is Gln or Ile; Xaa at position 261 is Gln, Glu, Lys or Ala; Xaa at position 278 is Glu or Asn; Xaa at position 281 is Gln, Lys or Glu; Xaa at position 289 is Lys, Leu, Val, Pro, Glu, Gln, Tyr, Thr or Asp; Xaa at position 293 is Arg, Glu or Gln; Xaa at position 313 is Lys or Gln; Xaa at position 328 is Lys, Glu or Gln; Xaa at position 333 is Ser, Gly, Lys, Val or Asn; Xaa at position 334 is Gly, Arg, Lys or Ile; Xaa at position 336 is Gly or Ala; Xaa at position 338 is Ser, His, Val, Lys or Ala; Xaa at position 339 is Glu, Asn, Ile or Pro; Xaa at position 343 is Val or Ile; Xaa at position 346 is Pro or Ala; Xaa at position 355 is Val or Ile; Xaa at position 359 is Gly or Ala; Xaa at position 391 is Arg, Leu, Glu, Gln, Asp or His; Xaa at position 396 is Ala, Leu, Lys, Asn, Gly or Thr; Xaa at position 401 is Ser, His, Pro, Gly, Lys, Val or Arg; Xaa at position 402 is Lys, Phe, His, Arg, Gly, Trp, Thr, Asn, Tyr or Met; Xaa at position 403 is Asp or Tyr; Xaa at position 411 is Pro or Ala; Xaa at position 412 is Pro or Ala; Xaa at position 416 is Arg or Glu; Xaa at position 417 is Ala or Ser; Xaa at position 418 is Leu or Met; Xaa at position 426 is Thr or Ser; Xaa at position 440 is Val or Leu; Xaa at position 447 is Asp, Lys, Tyr, Ser, Glu or Ile; Xaa at position 452 is Gln, Lys or Glu; Xaa at position 454 is Arg, Tyr, Met, Ser, Val, Ile, Lys, Phe, Trp or Gln; Xaa at position 455 is Val or Ile; Xaa at position 459 is Lys, Met, Val, Trp, Gln, Ile or Tyr; Xaa at position 461 is Thr or Ser; Xaa at position 462 is Gly or Ala; Xaa at position 463 is Ala or Ser; Xaa at position 464 is Arg, Gly, His, Ala, Asp, Ser or Lys; Xaa at position 465 is Lys, Asn, Val, Met, Pro, Gly or Arg; Xaa at position 471 is Gln, Lys, Glu or Met; Xaa at position 472 is Pro or Ser; Xaa at position 500 is Arg or Gln; Xaa at position 509 is Lys, Gln or Ala; Xaa at position 520 is Lys, Gln, Glu, His or Ala; and Xaa at position 527 is Gln, Lys, Pro, Cys or Glu; and having one or more amino acid substitutions at positions designated as Xaa in SEQ ID NO: 4 and wherein the PHI-4 polypeptide has increased insecticidal activity compared to the polypeptide of SEQ ID NO: 35.

In some embodiments exemplary nucleic acid molecules encode a PHI-4 of any one of SEQ ID NOs: 51-1162 and SEQ ID NOs: 1518-1526 as well as amino acid substitutions, amino acid deletions, insertions and fragments thereof and combinations thereof.

In some embodiments the nucleic acid molecules encode a PHI-4 polypeptide of Table 3, Table 4, Table 5, Table 6, Table 7, Table 8, and Table 9 and combinations of the amino acid substitutions thereof and amino acid deletions and/or insertions thereof.

Also provided are nucleic acid molecules that encode transcription and/or translation products that are subsequently spliced to ultimately produce functional PHI-4. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate a PHI-4 encoding sequence. An example of trans splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length PHI-4, but rather encode a fragment or fragments of a PHI-4. These polynucleotides can be used to express a functional PHI-4 through a mechanism involving splicing, where splicing can occur at the level of polynucleotide (e.g., intron/exon) and/or polypeptide (e.g., intein/extein). This can be useful, for example, in controlling expression of pesticidal activity, since functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding PHI-4 are also encompassed by the embodiments. By "fragment" is intended a portion of the nucleic acid sequence encoding a PHI-4. A fragment of a nucleic acid sequence may encode a biologically active portion of a PHI-4 polypeptide or it may be a fragment that can be used as a hybridization probe or PCR primer using methods disclosed below. Nucleic acid molecules that are fragments of a nucleic acid sequence encoding a PHI-4 comprise at least about 50, 100, 200, 300, 400, 500, 600 or 700, contiguous nucleotides or up to the number of nucleotides present in a full-length nucleic acid sequence encoding a PHI-4 disclosed herein, depending upon the intended use. By "contiguous" nucleotides is intended nucleotide residues that are immediately adjacent to one another. Fragments of the nucleic acid sequences of the embodiments will encode protein fragments that retain the biological activity of the PHI-4 and, hence, retain insecticidal activity. By "retains activity" is intended that the fragment will encode a polypeptide having at least about 30%, at least about 50%, at least about 70%, 80%, 90%, 95% or higher of the insecticidal activity of the full-length PHI-4. In one embodiment, the insecticidal activity is Lepodoptera activity. In another embodiment, the insecticidal activity is Hemiptera activity.

In some embodiments a fragment of a nucleic acid sequence encoding a PHI-4 encoding a biologically active portion of a protein will encode at least about 15, 25, 30, 50, 75, 100, 125, 150, 175, 200 or 250, contiguous amino acids or up to the total number of amino acids present in a full-length PHI-4 of the embodiments. In some embodiments, the fragment is an N-terminal or a C-terminal truncation of at least about 1, 2, 3, 4, 5, 6, 7, 8, 9, 10, 11, 12, 13, 14, 15, 16, 17, 18, 19, 20, 25 or more amino acids relative to SEQ ID NO: 35, SEQ ID NOs: 51-1162, SEQ ID NOs: 1518-1526 or variants thereof, e.g., by proteolysis, insertion of a start codon, deletion of the codons encoding the deleted amino acids with the concomitant insertion of a stop codon or by insertion of a stop codon in the coding sequence. In some embodiments, the fragments encompassed herein result from the removal of the N-terminal 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids relative to SEQ ID NO: 35, SEQ ID NOs: 51-1162, SEQ ID NOs: 1518-1526 or variants thereof, e.g., by proteolysis or by insertion of a start codon in the coding sequence.

In some embodiments the PHI-4 are encoded by a nucleic acid sequence sufficiently identical to the nucleic acid sequence of SEQ ID NO: 1, SEQ ID NO: 7, SEQ ID NO: 11, SEQ ID NOS: 24-30. By "sufficiently identical" is intended an amino acid or nucleic acid sequence that has at least about 60% or 65% sequence identity, about 70% or 75% sequence identity, about 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to a reference sequence using one of the alignment programs described herein using standard parameters. In some embodiments the sequence homology identity is against the full length sequence of the polynucleotide encoding a PHI-4 or against the full length sequence of a PHI-4 polypeptide. In some embodiments the polynucleotide encoding the PHI-4 has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1, SEQ ID NO: 7, SEQ ID NO: 11, SEQ ID NOS: 24-30. One of skill in the art will recognize that these values can be appropriately adjusted to determine corresponding identity of proteins encoded by two nucleic acid sequences by taking into account codon degeneracy, amino acid similarity, reading frame positioning, and the like.

To determine the percent identity of two amino acid sequences or of two nucleic acids, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 35 or across the entirety of one of SEQ ID NO: 1, SEQ ID NO: 7, SEQ ID NO: 11, SEQ ID NOS: 24-30). The percent identity between two sequences can be determined using techniques similar to those described below, with or without allowing gaps. In calculating percent identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, (1990) *Proc. Natl. Acad. Sci. USA* 87:2264, modified as in Karlin and Altschul, (1993) *Proc. Natl. Acad. Sci. USA* 90:5873-5877. Such an algorithm is incorporated into the BLASTN and BLASTX programs of Altschul, et al., (1990) *J. Mol. Biol.* 215:403. BLAST nucleotide searches can be performed with the BLASTN program, score=100, wordlength=12, to obtain nucleic acid sequences homologous to pesticidal-like nucleic acid molecules. BLAST protein searches can be performed with the BLASTX program, score=50, wordlength=3, to obtain amino acid sequences homologous to pesticidal protein molecules. To obtain gapped alignments for comparison purposes, Gapped BLAST (in BLAST 2.0) can be utilized as described in Altschul, et al., (1997) *Nucleic Acids Res.* 25:3389. Alternatively, PSI-Blast can be used to perform an iterated search that detects distant relationships between molecules. See, Altschul, et al., (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins, et al., (1994) *Nucleic Acids Res.* 22:4673-4680). ClustalW compares sequences and aligns the entirety of the amino acid or DNA sequence and thus can provide data about the sequence conservation of the entire amino acid sequence. The ClustalW algorithm is used in several commercially available DNA/amino acid analysis software packages, such as the ALIGNX® module of the Vector NTI® Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™. GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller, (1988) *CABIOS* 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12 and a gap penalty of 4 can be used.

Another non-limiting example of a mathematical algorithm utilized for the comparison of sequences is the algorithm of Needleman and Wunsch, (1970) *J. Mol.* 48(3):443-453, used GAP Version 10 software to determine sequence identity or similarity using the following default parameters: % identity and % similarity for a nucleic acid sequence using GAP Weight of 50 and Length Weight of 3 and the nwsgapdna.cmpii scoring matrix; % identity or % similarity for an amino acid sequence using GAP weight of 8 and length weight of 2, and the BLOSUM62 scoring program. Equivalent programs may also be used. By "equivalent program" is intended any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding variants of PHI-4 polypeptide. "Variants" of the PHI-4 polypeptide encoding nucleic acid sequences include those sequences that encode the PHI-4 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the PHI-4 polypeptides disclosed as discussed below.

The skilled artisan will further appreciate that changes can be introduced by mutation of the nucleic acid sequences thereby leading to changes in the amino acid sequence of the encoded PHI-4 polypeptides, without altering the biological activity of the proteins. Thus, variant nucleic acid molecules can be created by introducing one or more nucleotide substitutions, nucleotide additions and/or nucleotide deletions into the corresponding nucleic acid sequence disclosed herein, such that one or more amino acid substitutions, amino acid additions or amino acid deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries, and any recombinant polynucleotide produces by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness et al. (1999) *Nat Biotechnol* 17:893-896; Chang et al. (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene*, 164:49-53; Stemmer, (1995) *Science* 270:1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350; Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein (1986) *Nucl Acids Res* 14:9679-9698; Sayers, et al., (1988) *Nucl Acids Res* 16:791-802 and Sayers, et al., (1988) *Nucl Acids Res* 16: 803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A* 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA*, 83:7177-7181 and Arnold, (1993) *Curr Opin Biotech*

4:450-455). Additional details on many of the above methods can be found in *Methods Enzymol Volume* 154, which also describes useful controls for trouble-shooting problems with various mutagenesis methods.

Additional details regarding various diversity generating methods can be found in the following US patents, PCT Publications and applications and EPO Publications: U.S. Pat. No. 5,723,323, U.S. Pat. No. 5,763,192, U.S. Pat. No. 5,814,476, U.S. Pat. No. 5,817,483, U.S. Pat. No. 5,824,514, U.S. Pat. No. 5,976,862, U.S. Pat. No. 5,605,793, U.S. Pat. No. 5,811,238, U.S. Pat. No. 5,830,721, U.S. Pat. No. 5,834,252, U.S. Pat. No. 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401, and PCT/US01/06775.

The nucleotide sequences of the embodiments can also be used to isolate corresponding sequences from other organisms, particularly other bacteria. In this manner, methods such as PCR, hybridization and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential PHI-4 polypeptides from bacterial collections, the bacterial cell lysates can be screened with antibodies generated against a PHI-4 polypeptide using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of a PHI-4 polypeptide using protocols in the literatures (Patterson, (1998), 10(22):1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to a PHI-4 polypeptide) with sequence information of a PHI-4 polypeptide and its homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides, and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known PHI-4 polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding a PHI-4 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding a PHI-4 polypeptide, disclosed herein or one or more portions thereof, may be used as a probe capable of specifically hybridizing to corresponding nucleic acid sequences encoding PHI-4 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the Tm can be approximated from the equation of Meinkoth and Wahl, (1984) *Anal. Biochem.* 138:267-284: Tm=81.5° C.+16.6 (log M)+0.41% GC)-0.61% form)-500/L; where M is the molarity of monovalent cations, % GC the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization, and/or wash conditions can be adjusted to hybridize to sequences of the desired identity. For example, if sequences with ≥90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3 or 4° C. lower than the thermal melting point (Tm); moderately stringent conditions can utilize a hybridization and/or wash at 6, 7, 8, 9 or 10° C. lower than the thermal melting point (Tm); low stringency conditions can utilize a hybridization and/or wash at 11, 12, 13, 14, 15 or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology—Hybridization with Nucleic Acid Probes, Part I, Chapter 2 (Elsevier, N.Y.); and Ausubel, et al., eds. (1995) Current Protocols in Molecular Biology, Chapter 2 (Greene Publishing and Wiley-Interscience, New York). See, Sambrook, et al., (1989) Molecular Cloning: A Laboratory Manual (2d ed., Cold Spring Harbor Laboratory Press, Cold Spring Harbor, N.Y.).

Proteins and Variants and Fragments Thereof

PHI-4 polypeptides are encompassed by the disclosure. By "PHI-4 polypeptide" or "PHI-4 protein" as used herein interchangeably is intended a polypeptide that has increased insecticidal activity against one or more insect pests of the *Lepidoptera* and/or Coleoptera orders compared to the protein of SEQ ID NO: 35, and is sufficiently identical to the protein of SEQ ID NO: 35. A variety of PHI-4 polypeptides are contemplated.

The Western Corn Rootworm active protein AXMI-205 (SEQ ID NO: 35) encoded by the polynucleotide of SEQ ID NO: 34 was identified from the Chromobacterium Strain ATX 2024 (US20110023184). Synthetic genes encoding AXMI-205; AXMI-205 variants having a truncation of the last 10 and 20 amino acids from the C-terminus (SEQ ID NO: 36 and SEQ ID NO: 37); and alanine scanning at every other residue from residue 307-536 of AXMI-205 (SEQ ID NO: 35), with S307A, D315A, V317A, S349A, G351A, K353A, V355A, D395A, G399A, W407A, G419A, P435A, S443A, K465A, V467A, F483A, P487A, S495A, D497A, E499A, K509A, and 1513A identified as having WCRW activity; are disclosed in US20110023184. AXMI-205 variants evo 24 (E499A); evo25 (V467A—SEQ ID NO: 41); evo30 (V467L—SEQ ID NO: 42); PMlibl PoolIG2_p2al 1 (5468L—SEQ ID NO: 45); PMlibl PoolIG2_plcl (V467T—SEQ ID NO: 46), PMlibl PoolIG2_pla4 (R464N—SEQ ID NO: 47), evo34 (E86T—SEQ ID NO: 43) and evo35 (Q517R—SEQ ID NO: 44) having increased insecticidal activity are disclosed in WO2013/016617.

As used herein, the terms "protein," "peptide molecule" or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used to refer to a protein that is no longer in its natural environment, for example in vitro or in a recombinant bacterial or plant host cell. A PHI-4 polypeptide that is substantially free of cellular material includes preparations of protein having less than about 30%, 20%, 10% or 5% (by dry weight) of non-pesticidal protein (also referred to herein as a "contaminating protein").

By "improved activity" or "increased activity" is intended an increase of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1.1-fold, at least about 1.2-fold, at least about 1.3-fold, at least about 1.4-fold or at least about 1.5-fold, at least about 1.6-fold, at least about 1.7-fold, at least about 1.8-fold, at least about 1.9-fold, at least about 2-fold, at least about 2.1-fold, at least about 2.2-fold, at least about 2.3-fold, at least about 2.4-fold, at least about 2.5-fold, at least about 2.6-fold, at least about 2.7-fold, at least about 2.8-fold, at least about 2.9-fold, at least about 3-fold, at least about 3.1-fold, at least about 3.2-fold, at least about 3.3-fold, at least about 3.4-fold, at least about 3.5-fold, at least about 3.6-fold, at least about 3.7-fold, at least about 3.8-fold, at least about 3.9-fold, at least about 4-fold, at least about 4.1-fold, at least about 4.2-fold, at least about 4.3-fold, at least about 4.4-fold, at least about 4.5-fold, at least about 4.6-fold, at least about 4.7-fold, at least about 4.8-fold, at least about 4.9-fold, at least about 5-fold, at least about 5.1-fold, at least about 5.2-fold, at least about 5.3-fold, at least about 5.4-fold, at least about 5.5-fold, at least about 5.6-fold, at least about 5.7-fold, at least about 5.8-fold, at least about 5.9-fold, at least about 6-fold, at least about 6.1-fold, at least about 6.2-fold, at least about 6.3-fold, at least about 6.4-fold, at least about 6.5-fold, at least about 6.6-fold, at least about 6.7-fold, at least about 6.8-fold, at least about 6.9-fold, at least about 7-fold, at least about 7.1-fold, at least about 7.2-fold, at least about 7.3-fold, at least about 7.4-fold, at least about 7.5-fold, at least about 7.6-fold, at least about 7.7-fold, at least about 7.8-fold, at least about 7.9-fold, at least about 8-fold, at least about 8.1-fold, at least about 8.2-fold, at least about 8.3-fold, at least about 8.4-fold, at least about 8.5-fold, at least about 8.6-fold, at least about 8.7-fold, at least about 8.8-fold, at least about 8.9-fold, at least about 9-fold, at least about 9.1-fold, at least about 9.2-fold, at least about 9.3-fold, at least about 9.4-fold, at least about 9.5-fold, at least about 9.6-fold, at least about 9.7-fold, at least about 9.8-fold, at least about 9.9-fold, at least about 10-fold or higher increase in the pesticidal activity of the variant protein relative to the pesticidal activity of AXMI-205 (SEQ ID NO: 35).

In some embodiments, the improvement consists of a decrease in the EC50 of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1.1-fold, at least about 1.2-fold, at least about 1.3-fold, at least about 1.4-fold or at least about 1.5-fold, at least about 1.6-fold, at least about 1.7-fold, at least about 1.8-fold, at least about 1.9-fold, at least about 2-fold, at least about 2.1-fold, at least about 2.2-fold, at least about 2.3-fold, at least about 2.4-fold, at least about 2.5-fold, at least about 2.6-fold, at least about 2.7-fold, at least about 2.8-fold, at least about 2.9-fold, at least about 3-fold, at least about 3.1-fold, at least about 3.2-fold, at least about 3.3-fold, at least about 3.4-fold, at least about 3.5-fold, at least about 3.6-fold, at least about 3.7-fold, at least about 3.8-fold, at least about 3.9-fold, at least about 4-fold, at least about 4.1-fold, at least about 4.2-fold, at least about 4.3-fold, at least about 4.4-fold, at least about 4.5-fold, at least about 4.6-fold, at least about 4.7-fold, at least about 4.8-fold, at least about 4.9-fold, at least about 5-fold, at least about 5.1-fold, at least about 5.2-fold, at least about 5.3-fold, at least about 5.4-fold, at least about 5.5-fold, at least about 5.6-fold, at least about 5.7-fold, at least about 5.8-fold, at least about 5.9-fold, at least about 6-fold, at least about 6.1-fold, at least about 6.2-fold, at least about 6.3-fold, at least about 6.4-fold, at least about 6.5-fold, at least about 6.6-fold, at least about 6.7-fold, at least about 6.8-fold, at least about 6.9-fold, at least about 7-fold, at least about 7.1-fold, at least about 7.2-fold, at least about 7.3-fold, at least about 7.4-fold, at least about 7.5-fold, at least about 7.6-fold, at least about 7.7-fold, at least about 7.8-fold, at least about 7.9-fold, at least about 8-fold, at least about 8.1-fold, at least about 8.2-fold, at least about 8.3-fold, at least about 8.4-fold, at least about 8.5-fold, at least about 8.6-fold, at least about 8.7-fold, at least about 8.8-fold, at least about 8.9-fold, at least about 9-fold, at least about 9.1-fold, at least about 9.2-fold, at least about 9.3-fold, at least about 9.4-fold, at least about 9.5-fold, at least about 9.6-fold, at least about 9.7-fold, at least about 9.8-fold, at least about 9.9-fold, at least about 10-fold or greater reduction in the EC50 of the PHI-4 polypeptide relative to the pesticidal activity of AXMI-205 (SEQ ID NO: 35).

In some embodiments the EC50 of the PHI-4 polypeptide is <100 ppm, <90 ppm, <80 ppm, <70 ppm, <60 ppm, <50 ppm, <45 ppm, <40 ppm, <35 ppm, <30 ppm, <25 ppm, <20 ppm, <19 ppm, <18 ppm, <17 ppm, <16 ppm, <15 ppm, <14 ppm, <13 ppm, <12 ppm, <11 ppm, <10 ppm, <9 ppm, <8 ppm, <7 ppm, <6 ppm, <5 ppm, <4 ppm, <3 ppm, <2 ppm, <1 ppm, <0.9 ppm, <0.8 ppm, <0.7 ppm, <0.6 ppm, <0.5 ppm, <0.4 ppm, <0.3 ppm, <0.2 ppm or <0.1 ppm.

In some embodiments, the improvement consists of an increase in the Mean FAE Index of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1.1-fold, at least about 1.2-fold, at least about 1.3-fold, at least about 1.4-fold or at least about 1.5-fold, at least about 1.6-fold, at least about 1.7-fold, at least about 1.8-fold, at least about 1.9-fold, at least about 2-fold, at least about 2.1-fold, at least about 2.2-fold, at least about 2.3-fold, at least about 2.4-fold, at least about 2.5-fold, at least about 2.6-fold, at least about 2.7-fold, at least about 2.8-fold, at least about 2.9-fold, at least about 3-fold, at least about 3.1-fold, at least about 3.2-fold, at least about 3.3-fold, at least about 3.4-fold, at least about 3.5-fold, at least about 3.6-fold, at least about 3.7-fold, at least about 3.8-fold, at least about 3.9-fold, at least about 4-fold, at least about 4.1-fold, at least about 4.2-fold, at least about 4.3-fold, at least about 4.4-fold, at least about 4.5-fold, at least about 4.6-fold, at least about 4.7-fold, at least about 4.8-fold, at least about 4.9-fold, at least about 5-fold, at least about 5.1-fold, at least about 5.2-fold, at least about 5.3-fold, at least about 5.4-fold, at least about 5.5-fold, at least about 5.6-fold, at least about 5.7-fold, at least about 5.8-fold, at least about 5.9-fold, at least about 6-fold, at least about 6.1-fold, at least about 6.2-fold, at least about 6.3-fold, at least about 6.4-fold, at least about 6.5-fold, at least about 6.6-fold, at least about 6.7-fold, at least about 6.8-fold, at least about 6.9-fold, at least about 7-fold, at least about 7.1-fold, at least about 7.2-fold, at least about 7.3-fold, at least about 7.4-fold, at least about 7.5-fold, at least about 7.6-fold, at least about 7.7-fold, at least about 7.8-fold, at least about 7.9-fold, at least about 8-fold, at least about 8.1-fold, at least about 8.2-fold, at least about 8.3-fold, at least about 8.4-fold, at least about 8.5-fold, at least about 8.6-fold, at least about 8.7-fold, at least about 8.8-fold, at least about 8.9-fold, at least about 9-fold, at least about 9.1-fold, at least about 9.2-fold, at least about 9.3-fold, at least about 9.4-fold, at least about 9.5-fold, at least about 9.6-fold, at least about 9.7-fold, at least about 9.8-fold, at least about 9.9-fold, at least about 10-fold or higher increase in the Mean FAE Index of the PHI-4 polypeptide relative to the pesticidal activity of AXMI-205 (SEQ ID NO: 35).

In some embodiments, the improvement consists of an increase in the Mean Deviation Score of at least about 10%, at least about 15%, at least about 20%, at least about 25%, at least about 30%, at least about 35%, at least about 40%, at least about 50%, at least about 60%, at least about 70%, at least about 80%, at least about 90%, at least about 100%, at least about 110%, at least about 120%, at least about 130%, at least about 140%, at least about 150%, at least about 160%, at least about 170%, at least about 180%, at least about 190%, at least about 200%, at least about 210% at least about 220%, at least about 230%, at least about 240%, at least about 250%, at least about 260%, at least about 270%, at least about 280%, at least about 290%, at least about 300%, at least about 310%, at least about 320%, at least about 330%, at least about 340%, at least about 350%, at least about 360%, at least about 370%, at least about 380%, at least about 390%, at least about 400%, at least about 410%, at least about 420%, at least about 430%, at least about 440%, at least about 450%, at least about 460%, at least about 470%, at least about 480%, at least about 490%, at least about 500%, at least about 510%, at least about 520%, at least about 530%, at least about 540%, at least about 550%, at least about 560%, at least about 570%, at least about 580%, at least about 590%, at least about 600%, at least about 650%, at least about 700%, at least about 750%, at least about 800%, at least about 850%, at least about 900%, at least about 950%, at least about 1000% or higher or at least about 1.1-fold, at least about 1.2-fold, at least about 1.3-fold, at least about 1.4-fold or at least about 1.5-fold, at least about 1.6-fold, at least about 1.7-fold, at least about 1.8-fold, at least about 1.9-fold, at least about 2-fold, at least about 2.1-fold, at least about 2.2-fold, at least about 2.3-fold, at least about 2.4-fold, at least about 2.5-fold, at least about 2.6-fold, at least about 2.7-fold, at least about 2.8-fold, at least about 2.9-fold, at least about 3-fold, at least about 3.1-fold, at least about 3.2-fold, at least about 3.3-fold, at least about 3.4-fold, at least about 3.5-fold, at least about 3.6-fold, at least about 3.7-fold, at least about 3.8-fold, at least about 3.9-fold, at least about 4-fold, at least about 4.1-fold, at least about 4.2-fold, at least about 4.3-fold, at least about 4.4-fold, at least about 4.5-fold, at least about 4.6-fold, at least about 4.7-fold, at least about 4.8-fold, at least about 4.9-fold, at least about 5-fold, at least about 5.1-fold, at least about 5.2-fold, at least about 5.3-fold, at least about 5.4-fold, at least about 5.5-fold, at least about 5.6-fold, at least about 5.7-fold, at least about 5.8-fold, at least about 5.9-fold, at least about 6-fold, at least about 6.1-fold, at least about 6.2-fold, at least about 6.3-fold, at least about 6.4-fold, at least about 6.5-fold, at least about 6.6-fold, at least about 6.7-fold, at least about 6.8-fold, at least about 6.9-fold, at least about 7-fold, at least about 7.1-fold, at least about 7.2-fold, at least about 7.3-fold, at least about 7.4-fold, at least about 7.5-fold, at least about 7.6-fold, at least about 7.7-fold, at least about 7.8-fold, at least about 7.9-fold, at least about 8-fold, at least about 8.1-fold, at least about 8.2-fold, at least about 8.3-fold, at least about 8.4-fold, at least about 8.5-fold, at least about 8.6-fold, at least about 8.7-fold, at least about 8.8-fold, at least about 8.9-fold, at least about 9-fold, at least about 9.1-fold, at least about 9.2-fold, at least about 9.3-fold, at least about 9.4-fold, at least about 9.5-fold, at least about 9.6-fold, at least about 9.7-fold, at least about 9.8-fold, at least about 9.9-fold, at least about 10-fold or higher increase in the Mean Deviation Score of the PHI-4 polypeptide relative to the pesticidal activity of AXMI-205 (SEQ ID NO: 35).

In some embodiments the improved activity of the PHI-4 polypeptide is relative to the pesticidal activity of AXMI-205(evo25) (SEQ ID NO: 41), AXMI-205(evo30) (SEQ ID NO: 42), Axmi205 PMlibl PoolIG2_p2al 1 (mutation S468L; SEQ ID NO: 45), Axmi205 PMlibl PoolIG2_plcl (mutation V467T; SEQ ID NO: 46), Axmi205 PMlibl PoolIG2_pla4 (mutation R464N; SEQ ID NO: 47), AXMI-205(evo34) (SEQ ID NO: 43) or AXMI-205(evo35) (SEQ ID NO: 44).

"Mean FAE Index" (MFI) refers to the mean of multiple FAEGN an arithmetic mean of FAEGN. As used herein, the "Mean Deviation Score" refers to the arithmetic mean of multiple Deviation Scores.

In some embodiments the PHI-4 polypeptides have increased insecticidal activity against one or more insect pests of the order Coleoptera.

In some embodiments the PHI-4 polypeptides have increased insecticidal activity against one or more insect pests of the corn rootworm complex (western corn rootworm, *Diabrotica virgifera*; northern corn rootworm, *D. barberi*: and the Mexican corn rootworm, *D. virgifera zeae*.

In some embodiments the PHI-4 polypeptides have increased insecticidal activity against *Diabrotica virgifera* larvae—Western Corn Root Worm (WCRW).

"Fragments" or "biologically active portions" include polypeptide fragments comprising amino acid sequences sufficiently identical to a PHI-4 polypeptide and that exhibit insecticidal activity. "Fragments" or "biologically active portions" include polypeptide fragments comprising amino acid sequences sufficiently identical to the amino acid sequence set forth in SEQ ID NO: 35, SEQ ID NOs: 51-1162, and SEQ ID NOs: 1518-1526 and that exhibit insecticidal activity. A biologically active portion of a PHI-4 polypeptide can be a polypeptide that is, for example, 10, 25, 50, 100, 150, 200, 250, 300, 350, 400, 450, 500, 516, 517, 518, 519, 520, 521, 522, 523, 524, 525, 526, 527, 528, 529, 530, 531, 532, 533, 534 or 535 amino acids in length. Such biologically active portions can be prepared by recombinant techniques and evaluated for insecticidal activity. As used here, a fragment comprises at least 8 contiguous amino acids of a PHI-4 polypeptide. In some embodiments a fragment comprises at least 8 contiguous amino acids of SEQ ID NO: 2, SEQ ID NOs: 51-1162, or SEQ ID NOs: 1518-1526. In some embodiments a fragment comprises at least 8 contiguous amino acids of SEQ ID NO: 2 or SEQ ID NOs: 51-1162, or SEQ ID NOs: 1518-1526. The embodiments encompass other fragments, however, such as any fragment in the protein greater than about 10, 20, 30, 50, 100, 150, 200, 250 or more amino acids.

In some embodiments, the fragment is an N-terminal and/or a C-terminal truncation of at least about 1, 2, 3, 4, 5, 6, 7, 8, 9, 10, 11, 12, 13, 14, 15, 16, 17, 18, 19, 20, 25 or more amino acids relative to SEQ ID NO: 2, SEQ ID NO: 35, SEQ ID NOs: 51-1162, SEQ ID NOs: 1518-1526 or variants thereof e.g., by proteolysis, by insertion of a start codon, by deletion of the codons encoding the deleted amino acids and concomitant insertion of a start codon and/or insertion of a stop codon. In some embodiments, the fragments encompassed herein result from the removal of the C-terminal 1, 2, 3, 4, 5, 6, 7, 8, 9, 10, 11, 12, 13, 14, 15, 16, 17, 18, 19, 20, 21, 22, 23, 24, 25, 26, 27, 28 or 29 amino acids relative to SEQ ID NO: 35, SEQ ID NO: 2, SEQ ID NO: 3, SEQ ID NO: 4, SEQ ID NOs: 51-1162, SEQ ID NOs: 1518-1526, and variants thereof by proteolysis or by insertion of a start codon, by deletion of the codons encoding the deleted amino acids and concomitant insertion of a start codon. In particular embodiments the proteolytic cleavage site is between Lys at 520 and Ser at 521 Ser or Lys at 313 and Val at 314 of SEQ ID NO: 35 or variants thereof. It is well known in the art that polynucleotide encoding the truncated PHI-4 polypeptide can be engineered to add a start codon at the N-terminus such as ATG encoding methionine or methionine followed by an alanine. It is also well known in the art that depending on what host the PHI-4 polypeptide is expressed in the methionine may be partially of completed processed off.

In some embodiments fragments, biologically active portions, of SEQ ID NO: 2, SEQ ID NO: 3, SEQ ID NO: 4, SEQ ID NOs: 51-1162, SEQ ID NOs: 1518-1526 as well as amino acid substitutions, amino acid deletions and/or insertions thereof are also provided, and may be used to practice the methods of the disclosure.

In some embodiments PHI-4 polypeptides are provided having one or more amino acid substitution compared to AXMI-205 (SEQ ID NO: 35). In some embodiments PHI-4 polypeptides are provided having amino acid substitutions at solvent exposed surface residues to modify the protein characteristics of AXMI-205 (SEQ ID NO: 35), including but not limited to the ionic polarity of the protein surface. In some embodiments PHI-4 polypeptides are provided having amino acid substitutions at hydrophilic residues such as Asp, Glu, Lys, Arg, His, Ser, Thr, Tyr, Trp, Asn, Gln, and Cys. In some embodiments the PHI-4 polypeptides are provided having amino acid substitutions changing a Lysine or Arginine to a Glutamine, Glutamic Acid, Asparagine or Glutamic Acid; changing a Glutamic Acid or Aspartic Acid to a Lysine, Asparagine or Glutamine; and changing a Glutamine to a Asparagine or Lysine.

In some embodiments PHI-4 polypeptides are provided having amino acid substitutions at residues in a membrane insertion loop. In some embodiments PHI-4 polypeptides are provided having amino acid substitutions in a membrane insertion loop between about amino acid at position 92 (Val) and 101 (Ala) and/or at position 211 (Gly) and 220 (Glu) relative to SEQ ID NO: 35.

In some embodiments PHI-4 polypeptides are provided having amino acid substitutions at residues and receptor binding loops. In some embodiments PHI-4 polypeptides are provided having amino acid substitutions at residues and receptor binding loops between about amino acid 332 (Asp) and 340 (Asp), 395 (Asp) and 403 (Asp), 458 (Asp) and 466 (Asp) relative to SEQ ID NO: 35.

In some embodiments PHI-4 polypeptides are provided having amino acid substitutions at residues in a protease sensitive region. In some embodiments PHI-4 polypeptides are provided having amino acid substitutions at residues in a protease sensitive region from about amino acid residues between 305 (Lys) and 316 (Lys) and 500 (Arg) and 535 (Lys) relative to SEQ ID NO: 35.

By variants is intended proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identical to the parental amino acid sequence. In some embodiments a PHI-4 polypeptide has at least about 60%, 65%, about 70%, 75%, at least about 80%, 81%, 82%, 83%, 84%, 85%, 86%, 87%, 88%, 89%, 90%, 91%, 92%, 93%, 94%, 95%, 96%, 97%, 98% or 99% or greater identity across the entire length of the amino acid sequence of SEQ ID NO: 2, SEQ ID NOs: 51-1162, SEQ ID NOs: 1518-1526. In some embodiments a PHI-4 polypeptide has at least about 80%, 81%, 82%, 83%, 84%, 85%, 86%, 87%, 88%, 89%, 90%, 91%, 92%, 93%, 94%, 95%, 96%, 97%, 98% or 99% or greater identity across the entire length of the amino acid sequence of any one of SEQ ID NO: 2, SEQ ID NOs: 51-1162, or SEQ ID NOs: 1518-1526.

In some embodiments a PHI-4 polypeptide comprises an amino acid sequence having at least 80% identity, to the amino acid sequence of any one of SEQ ID NO: 2, SEQ ID NO: 3, SEQ ID NO: 4, SEQ ID NOs: 51-1162 or SEQ ID NO: 1518-1526, wherein the polypeptide has insecticidal activity.

In some embodiments a PHI-4 polypeptide comprises an amino acid sequence having at least 90% identity to the amino acid sequence of any one of SEQ ID NO: 2, SEQ ID NO: 3, SEQ ID NO: 4, SEQ ID NOs: 51-1162 or SEQ ID NO: 1518-1526, wherein the polypeptide has insecticidal activity.

In some embodiments a PHI-4 polypeptide comprises an amino acid sequence having at least 95% identity to the amino acid sequence of any one of SEQ ID NO: 2, SEQ ID NO: 3, SEQ ID NO: 4, SEQ ID NOs: 51-1162 or SEQ ID NO: 1518-1526 wherein the polypeptide has insecticidal activity.

In some embodiments a PHI-4 polypeptide comprises an amino acid sequence having at least 97% identity to the amino acid sequence of any one of SEQ ID NO: 2, SEQ ID NO: 3, SEQ ID NO: 4, SEQ ID NOs: 51-1162 or SEQ ID NO: 1518-1526, wherein the polypeptide has insecticidal activity.

In some embodiments a PHI-4 polypeptide comprises an amino acid sequence of SEQ ID NO: 3, wherein Xaa at position 2 is Ala or Arg; Xaa at position 9 is Gln, Lys or Glu; Xaa at position 14 is Pro or Ala; Xaa at position 16 is Val or Asp; Xaa at position 19 is Met or Leu; Xaa at position 22 is Gly or Ser; Xaa at position 24 is Asp, Asn or Gln; Xaa at position 36 is Leu or Met; Xaa at position 42 is Asp, Asn or Gln; Xaa at position 43 is Phe or Glu; Xaa at position 46 is Glu, Asp, Asn or Gly; Xaa at position 50 is Ile or Val; Xaa at position 51 is Glu or Gln; Xaa at position 55 is Arg or Lys; Xaa at position 56 is Ser or Thr; Xaa at position 57 is Tyr or Phe; Xaa at position 58 is Thr or Ser; Xaa at position 61 is Arg, Lys or Glu; Xaa at position 73 is Phe or Tyr; Xaa at position 74 is Lys, Glu, Gly, Arg, Met, Leu, His or Asp; Xaa at position 76 is Asp or Gln; Xaa at position 79 is Lys or Glu; Xaa at position 80 is Glu or Ser; Xaa at position 82 is Glu, Ile, Leu, Tyr or Gln; Xaa at position 83 is Glu or Gln; Xaa at position 84 is Tyr or Phe; Xaa at position 86 is Glu or Gln; Xaa at position 87 is Lys or Gln; Xaa at position 88 is Met, Ile or Leu; Xaa at position 90 is Gln or Glu; Xaa at position 94 is Val or Ile; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile, Met, Phe, Cys, Val or Asn; Xaa at position 103 is Ala or Gly; Xaa at position 105 is Leu or Ile; Xaa at position 109 is Phe, Lys, Gly, Met, Ser, Asp, Asn, Glu, Cys, Ala or Arg; Xaa at position 112 is Thr or Ser; Xaa at position 113 is Asp, Glu or Met; Xaa at position 117 is Thr or Ser; Xaa at position 121 is Tyr or Phe; Xaa at position 127 is Ala or Thr; Xaa at position 142 is Arg or Glu; Xaa at position 146 is Arg or Gln; Xaa at position 147 is Arg, Glu or Gln; Xaa at position 148 is Asp, Phe, Pro, Val, Glu, His, Trp, Ala, Arg, Leu, Ser, Gln or Gly; Xaa at position 149 is Phe or Val; Xaa at position 150 is Arg, Gln, Glu or Asn; Xaa at position 151 is Asp, Ser, Ala, Asn, Trp, Val, Gln, Cys, Met, Leu, Arg or Glu; Xaa at position 153 is Leu or Ile; Xaa at position 154 is Asn or Asp; Xaa at position 155 is Asn or Lys; Xaa at position 159 is Pro or Asp; Xaa at position 162 is Glu, Asp, Gln, Asn or Leu; Xaa at position 165 is Lys, Glu, Gln, Pro, Thr, Ala, Leu, Gly, Asp, Val, His, Ile, Met, Trp, Phe, Tyr or Arg; Xaa at position 166 is Arg or Gln; Xaa at position 167 is Tyr, Trp or Cys; Xaa at position 170 is Tyr or His; Xaa at position 171 is Tyr or Phe; Xaa at position 172 is Ile, Leu or Val; Xaa at position 173 is Ser or Ala; Xaa at position 174 is Glu, Gln, Asn, Lys, Val or Ser; Xaa at position 182 is Asp or Gln; Xaa at position 183 is Tyr or Val; Xaa at position 184 is Ser or Thr; Xaa at position 185 is Ala or Ser; Xaa at position 189 is Thr, Lys or Ile; Xaa at position 191 is Lys or Gln; Xaa at position 193 is Asp or Asn; Xaa at position 196 is Gln, Lys, Asn, Asp, Glu, Ala, Ile or Arg; Xaa at position 202 is Ala or Val; Xaa at position 203 is Glu, Thr or His; Xaa at position 204 is Met or Ala; Xaa at position 206 is Tyr or Phe; Xaa at position 207 is Lys or Gln; Xaa at position 209 is Leu or Pro; Xaa at position 210 is Val or Ile; Xaa at position 214 is Lys, Ser or Gln; Xaa at position 216 is Glu, Gln, Phe, Val, Tyr or Arg; Xaa at position 220 is Glu, His, Asp, Thr, Tyr, Val, Ser, Gln, Arg, Trp, Met, Ala, Phe, Ile, Leu, Cys or Asn; Xaa at position 229 is Arg or Glu; Xaa at position 230 is Ser or Glu; Xaa at position 231 is Asn or Ser; Xaa at position 236 is Leu or Pro; Xaa at position 245 is Met or Leu; Xaa at position 247 is Asp or Tyr; Xaa at position 256 is Gln, Lys or Glu; Xaa at position 257 is Gln, Ile, Glu, Cys, Ser, His, Trp or Met; Xaa at position 261 is Gln, Glu, Lys or Ala; Xaa at position 264 is Glu or Gln; Xaa at position 268 is Asp or Asn; Xaa at position 276 is Ser or Ala; Xaa at position 278 is Glu, Asn or Gln; Xaa at position 281 is Gln, Lys or Glu; Xaa at position 282 is Pro or Gly; Xaa at position 284 is Trp or Arg; Xaa at position 287 is Ala or Cys; Xaa at position 289 is Lys, Leu, Val, Pro, Glu, Gln, Tyr, Thr, Asp, Phe, Ser, Met, Arg, Trp, Ile, His, Asn, Cys, Gly or Ala; Xaa at position 291 is Glu or Gln; Xaa at position 292 is Arg or Gln; Xaa at position 293 is Arg, Glu or Gln; Xaa at position 294 is Val or Ala; Xaa at position 296 is Leu or Ile; Xaa at position 297 is Glu or Gln; Xaa at position 298 is Asp or Gln; Xaa at position 300 is Phe or Tyr; Xaa at position 302 is Glu or Gln; Xaa at position 303 is Phe or Tyr; Xaa at position 305 is Lys, Gln, Ala, Ile, Met, Asn, Thr or Val; Xaa at position 306 is Gln or Lys; Xaa at position 309 is Gln, Lys or Glu; Xaa at position 313 is Lys, Gln or Arg; Xaa at position 316 is Lys or Gln; Xaa at position 328 is Lys, Glu or Gln; Xaa at position 331 is Glu, Asn or Gln; Xaa at position 333 is Ser, Arg, Gly, Lys, Val, Asn, Ala, His, Gln, Thr, Asp, Ile, Leu, Cys or Glu; Xaa at position 334 is Gly, Arg, Lys, Ile or Trp; Xaa at position 335 is Ser or Ala; Xaa at position 336 is Gly or Ala; Xaa at position 337 is Ala, Val or Gly; Xaa at position 338 is Ser, His, Val, Lys, Ala, Gly, Thr, Ile, Glu, Met, Arg, Pro, Asp, Asn or Leu; Xaa at position 339 is Glu, Asn, Gln, Ile, Pro, Met, Ser, Ala, Cys, Phe, Val, Leu, Asp, Trp, His or Arg; Xaa at position 341 is Leu or Val; Xaa at position 342 is Ala, Ser or Val; Xaa at position 343 is Val or Ile; Xaa at position 344 is Phe or Trp; Xaa at position 345 is Asn or His; Xaa at position 346 is Pro or Ala; Xaa at position 350 is Asn or Ser; Xaa at position 351 is Gly or Val; Xaa at position 354 is Met or Leu; Xaa at position 355 is Val, Ile or Leu; Xaa at position 359 is Gly or Ala; Xaa at position 362 is Asn or Ser; Xaa at position 364 is Ala or Ser; Xaa at position 371 is Ala, Gly or Thr; Xaa at position 374 is Phe or Ile; Xaa at position 375 is Lys or Arg; Xaa at position 380 is Leu or Gly; Xaa at position 382 is Val, Asp or Leu; Xaa at position 383 is Leu, Ile or Val; Xaa at position 384 is Lys, Ala or Gly; Xaa at position 385 is Ala or Gly; Xaa at position 389 is Trp or Tyr; Xaa at position 391 is Arg, Leu, Glu, Gln, Asp or His; Xaa at position 395 is Asp or Cys; Xaa at position 396 is Ala, Leu, Lys, Asn, Gly, Ile, Met, Arg, Tyr, Gln, His or Thr; Xaa at position 397 is Gly, Arg or Ala; Xaa at position 398 is Ser, Gln or Cys; Xaa at position 401 is Ser, His, Pro, Gly, Lys, Val, Arg, Ile, Asn, Phe, Thr, Ala, Asp, Met, Gln or Glu; Xaa at position 402 is Lys, Phe, His, Arg, Trp, Gly, Asn, Leu, Tyr, Thr, Val, Met, Pro or Ala; Xaa at position 403 is Asp, Tyr, Trp, Phe or Glu; Xaa at position 405 is Ala or Ser; Xaa at position 409 is Ala or Pro; Xaa at position 410 is Ile or Val; Xaa at position 411 is Pro or Ala; Xaa at position 412 is Pro or Ala; Xaa at position 416 is Arg, Glu or Gln; Xaa at position 417 is Ala, Ser or Cys; Xaa at position 418 is Leu or Met; Xaa at position 422 is Met or Val; Xaa at position 426 is Thr or Ser; Xaa at position 436 is Asp or Lys; Xaa at position 437 is Tyr or Val; Xaa at position 438 is Val or Arg; Xaa at position 440 is Val or Leu; Xaa at position 442 is Gln, Lys or Glu; Xaa at position 445 is Cys, Leu or Thr; Xaa at position 447 is Asp, Lys, Tyr, Ser, Glu, Ile, Gly, Pro, Leu, Phe, Trp or Thr; Xaa at position 448 is Val or Ala; Xaa at position 449 is Gln or Glu; Xaa at position 452 is Gln, Lys or Glu, Ala; Xaa at position 453 is Asn or Asp; Xaa at position 454 is Arg, Tyr, Met, Ser, Val, Ile, Lys, Phe, Trp, Gln, Gly, His, Asp, Leu, Thr, Pro or Asn; Xaa at position 455 is Val or Ile; Xaa at position 457 is Trp or Asn; Xaa at position 459 is Lys, Met, Val, Trp, Gln, Ile, Thr, Ser, His, Cys, Tyr, Pro, Asn, Ala, Arg or Glu; Xaa at position 460 is Gly or Ala; Xaa at position 461 is Thr or Ser; Xaa at position 462 is Gly or Ala; Xaa at position 463 is Ala, Ser or Gly; Xaa at position 464 is Arg, Gly, His, Gln, Thr, Phe, Ala, Asp, Ser or Lys; Xaa at position 465 is Lys, Asn, Val, Met, Pro, Gly, Arg, Thr, His, Cys, Trp, Phe or Leu; Xaa at position 466 is Asp or Arg; Xaa at position 471 is Gln, Lys, Glu or Met; Xaa at position 472 is Pro or Ser; Xaa at position 497 is Asp or Gln; Xaa at position 499 is Glu or Gln; Xaa at position 500 is Arg, Gln or Lys; Xaa at position 502 is Arg, Glu or Gln; Xaa at position 509 is Lys, Gln, Glu or Ala; Xaa at position 517 is Gln, Cys, Asn, Val or Pro; Xaa at position 518 is Glu or Gln; Xaa at position 520 is Lys, Gln, Glu, His or Ala; Xaa at position 525 is Gln or Lys; and Xaa at position 527 is Gln, Lys, Pro, Cys, Glu, Ser, His, Phe or Trp; and having one or more amino acid substitutions at positions designated as Xaa in SEQ ID NO: 3; and amino acid substitutions, deletions, insertions, and combinations thereof and fragments thereof; and wherein the PHI-4 polypeptide has increased insecticidal activity compared to SEQ ID NO: 2.

In some embodiments a PHI-4 polypeptide comprises an amino acid sequence of SEQ ID NO: 4 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60 or 61 amino acid substitutions, in any combination, at residues designated by Xaa in SEQ ID NO: 4 compared to the native amino acid at the corresponding position of SEQ ID NO: 2.

In some embodiments a PHI-4 polypeptide comprises an amino acid sequence of SEQ ID NO: 4 having 1, 2, 3, 4, 5, 6, 7, 8, 9, 10 11, 12, 13, 14, 15, 16, 17, 18, 19 or 20 amino acid substitutions, in any combination, at residues designated by Xaa in SEQ ID NO: 4 compared to the native amino acid at the corresponding position of SEQ ID NO: 2.

In some embodiments a PHI-4 polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or greater sequence identity to the amino acid sequence of SEQ ID NO: 4.

In some embodiments a PHI-4 polypeptide comprises an amino acid sequence of SEQ ID NO: 4, wherein Xaa at position 2 is Ala or Arg; Xaa at position 24 is Asp or Asn; Xaa at position 42 is Asp or Asn; Xaa at position 43 is Phe or Glu; Xaa at position 46 is Glu or Asn; Xaa at position 74 is Lys, Glu or Gly; Xaa at position 79 is Lys or Glu; Xaa at position 82 is Glu, Ile, Leu or Tyr; Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu; Xaa at position 98 is Tyr or Phe; Xaa at position 99 is Lys, Leu, Tyr, Ile or Met; Xaa at position 109 is Phe, Lys, Gly, Met, Ser, Asp or Asn; Xaa at position 147 is Arg or Glu; Xaa at position 148 is Asp, Phe or Pro; Xaa at position 150 is Arg, Gln, Glu or Asn; Xaa at position 151 is Asp, Ser, Ala or Asn; Xaa at position 153 is Leu or Ile; Xaa at position 162 is Glu, Asp, Gln, Asn or Leu; Xaa at position 165 is Lys, Glu or Gln; Xaa at position 166 is Arg or Gln; Xaa at position 171 is Tyr or Phe; Xaa at position 174 is Glu, Gln, Asn, Lys, Val or Ser; Xaa at position 182 is Asp or Gln; Xaa at position 196 is Gln, Lys, Asn or Asp; Xaa at position 203 is Glu, Thr or His; Xaa at position 206 is Tyr or Phe; Xaa at position 216 is Glu or Gln; Xaa at position 220 is Glu, His, Asp, Thr, Tyr, Val, Ser or Gln; Xaa at position 247 is Asp or Tyr; Xaa at position 256 is Gln or Lys; Xaa at position 257 is Gln or Ile; Xaa at position 261 is Gln, Glu, Lys or Ala; Xaa at position 278 is Glu or Asn; Xaa at position 281 is Gln, Lys or Glu; Xaa at position 289 is Lys, Leu, Val, Pro, Glu, Gln, Tyr, Thr or Asp; Xaa at position 293 is Arg, Glu or Gln; Xaa at position 313 is Lys or Gln; Xaa at position 328 is Lys, Glu or Gln; Xaa at position 333 is Ser, Gly, Lys, Val or Asn; Xaa at position 334 is Gly, Arg, Lys or Ile; Xaa at position 336 is Gly or Ala; Xaa at position 338 is Ser, His, Val, Lys or Ala; Xaa at position 339 is Glu, Asn, Ile or Pro; Xaa at position 343 is Val or Ile; Xaa at position 346 is Pro or Ala; Xaa at position 355 is Val or Ile; Xaa at position 359 is Gly or Ala; Xaa at position 391 is Arg, Leu, Glu, Gln, Asp or His; Xaa at position 396 is Ala, Leu, Lys, Asn, Gly or Thr; Xaa at position 401 is Ser, His, Pro, Gly, Lys, Val or Arg; Xaa at position 402 is Lys, Phe, His, Arg, Gly, Trp, Thr, Asn, Tyr or Met; Xaa at position 403 is Asp or Tyr; Xaa at position 411 is Pro or Ala; Xaa at position 412 is Pro or Ala; Xaa at position 416 is Arg or Glu; Xaa at position 417 is Ala or Ser; Xaa at position 418 is Leu or Met; Xaa at position 426 is Thr or Ser; Xaa at position 440 is Val or Leu; Xaa at position 447 is Asp, Lys, Tyr, Ser, Glu or Ile; Xaa at position 452 is Gln, Lys or Glu; Xaa at position 454 is Arg, Tyr, Met, Ser, Val, Ile, Lys, Phe, Trp or Gln; Xaa at position 455 is Val or Ile; Xaa at position 459 is Lys, Met, Val, Trp, Gln, Ile or Tyr; Xaa at position 461 is Thr or Ser; Xaa at position 462 is Gly or Ala; Xaa at position 463 is Ala or Ser; Xaa at position 464 is Arg, Gly, His, Ala, Asp, Ser or Lys; Xaa at position 465 is Lys, Asn, Val, Met, Pro, Gly or Arg; Xaa at position 471 is Gln, Lys, Glu or Met; Xaa at position 472 is Pro or Ser; Xaa at position 500 is Arg or Gln; Xaa at position 509 is Lys, Gln or Ala; Xaa at position 520 is Lys, Gln, Glu, His or Ala; and Xaa at position 527 is Gln, Lys, Pro, Cys or Glu; and having one or more amino acid substitutions at positions designated as Xaa in SEQ ID NO: 4; and amino acid substitutions, deletions, insertions, and combinations thereof and fragments thereof; and wherein the PHI-4 polypeptide has increased insecticidal activity compared to SEQ ID NO: 2.

In some embodiments a PHI-4 polypeptide comprises an amino acid sequence of SEQ ID NO: 3 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75 or 76 amino acid substitutions, in any combination, at residues designated by Xaa in SEQ ID NO: 3 compared to the native amino acid at the corresponding position of SEQ ID NO: 2.

In some embodiments PHI-4 polypeptide comprises an amino acid sequence of SEQ ID NO: 3 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53 or 54 amino acid substitutions, in any combination, at residues designated by Xaa in SEQ ID NO: 3 compared to the native amino acid at the corresponding position of SEQ ID NO: 2.

In some embodiments PHI-4 polypeptide comprises an amino acid sequence of SEQ ID NO: 3 having 1, 2, 3, 4, 5, 6, 7, 8, 9, 10 11, 12, 13, 14 or 15 amino acid substitutions, in any combination, at residues designated by Xaa in SEQ ID NO: 3 compared to the native amino acid at the corresponding position of SEQ ID NO: 2.

In some embodiments a PHI-4 polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or greater sequence identity to the amino acid sequence of SEQ ID NO: 3.

In some embodiments a PHI-4 polypeptide comprises one or more amino acid substitutions compared to the native amino acid at position 40, 42, 43, 46, 52, 97, 98, 99, 145, 150, 151, 153, 163, 171, 172, 182, 196, 206, 210, 216, 220, 278, 283, 289, 293, 328, 333, 334, 336, 338, 339, 342, 346, 354, 355, 370, 389, 393, 396, 401, 402, 403, 410, 412, 416, 417, 426, 442, 447, 452, 454, 455, 457, 461, 462, 500, 509, 520 or 527 of SEQ ID NO: 35.

In some embodiments a PHI-4 polypeptide comprises one or more amino acid substitutions compared to the native amino acid at position 40, 42, 43, 46, 52, 97, 98, 99, 145, 150, 151, 153, 163, 171, 172, 182, 196, 206, 210, 216, 220, 278, 283, 289, 293, 328, 333, 334, 336, 338, 339, 342, 346, 354, 355, 370, 389, 393, 396, 401, 402, 403, 410, 412, 416, 417, 426, 442, 447, 452, 454, 455, 457, 461, 462, 500, 509, 520 or 527 of SEQ ID NO: 35 wherein the amino acid at position 40 is Leu or Ile; the amino acid at position 42 is Asp or Asn; the amino acid at position 43 is Phe or Glu; the amino acid at position 46 is Glu or Asn; the amino acid at position 52 is Ile or Val; the amino acid at position 97 is Arg, Asp, Glu or Asn; the amino acid at position 98 is Tyr or Phe; the amino acid at position 99 is Lys or Leu; the amino acid at position 145 is Leu or Val; the amino acid at position 150 is Arg or Gln; the amino acid at position 151 is Asp or Ser; the amino acid at position 153 is Leu or Ile; the amino acid at position 163 is Leu or Val; the amino acid at position 171 is Tyr or Phe; the amino acid at position 172 is Ile or Leu; the amino acid at position 182 is Asp or Gln; the amino acid at position 196 is Gln or Asn; the amino acid at position 206 is Tyr or Phe; the amino acid at position 210 is Val or Ile; the amino acid at position 216 is Glu or Gln; the amino acid at position 220 is Glu, Gln, His or Asp; the amino acid at position 278 is Glu or Asn; the amino acid at position 283 is Ile or Val; the amino acid at position 289 is Lys, Gln or Leu; the amino acid at position 293 is Arg, Gln or Glu; the amino acid at position 328 is Lys or Glu; the amino acid at position 333 is Ser, Lys or Val; the amino acid at position 334 is Gly, Lys or Arg; the amino acid at position 336 is Gly or Ala; the amino acid at position 338 is Ser or Val; the amino acid at position 339 is Glu, Asn or Gln; the amino acid at position 342 is Ala or Ser; the amino acid at position 346 is Pro or Ala; the amino acid at position 354 is Met or Leu; the amino acid at position 355 is Val or Ile; the amino acid at position 370 is His or Arg; the amino acid at position 389 is Trp or Leu; the amino acid at position 393 is Trp or Leu; the amino acid at position 396 is Ala, Leu, Lys, Thr or Gly; the amino acid at position 401 is Ser, His, Gly, Lys or Pro; the amino acid at position 402 is Lys, His, Gly or Trp; the amino acid at position 403 is Asp or Tyr; the amino acid at position 410 is Ile or Val; the amino acid at position 412 is Pro or Ala; the amino acid at position 416 is Arg or Glu; the amino acid at position 417 is Ala or Ser; the amino acid at position 426 is Thr or Ser; the amino acid at position 442 is Gln or Glu; the amino acid at position 447 is Asp or Lys; the amino acid at position 452 is Gln or Lys; the amino acid at position 454 is Arg or Gln; the amino acid at position 455 is Val or Ile; the amino acid at position 457 is Trp or Asn; the amino acid at position 461 is Thr or Ser; the amino acid at position 462 is Gly or Ala; the amino acid at position 500 is Arg or Gln; the amino acid at position 509 is Lys or Gln; the amino acid at position 520 is Lys, Glu or Gln; and the amino acid at position 527 is Gln or Lys, and amino acid deletions, insertions, and combinations thereof and fragments thereof.

In some embodiments the PHI-4 polypeptide comprising one or more amino acid substitutions at position 86, 359, 399, 464, 465, 466, 467, 468, 499 or 517.

In some embodiments the PHI-4 polypeptide comprising one or more amino acid substitutions at position 86, 359, 399, 464, 465, 466, 467, 468, 499 or 517, wherein the amino acid at position 86 is Glu or Thr; the amino acid at position 359 is Gly or Ala; the amino acid at position 399 is Gly or Ala; the amino acid at position 464 is Arg, Ala, Lys, Asp or Asn; the amino acid at position 465 is Lys or Met, the amino acid at position 467 is Val, Ala, Leu or Thr; the amino acid at position 468 is Ser or Leu; the amino acid at position 499 is Glu or Ala or the amino acid at position 517 is Glu or Arg.

In some embodiments exemplary PHI-4 polypeptides are encoded by the polynucleotide sequence set forth in SEQ ID NO: 1, SEQ ID NO: 7, SEQ ID NO: 11, SEQ ID NOs: 24-30, SEQ ID NOs. 1163-1505, and SEQ ID NOs. 1527-1535.

In some embodiments a PHI-4 polypeptide includes variants where an amino acid that is part of a proteolytic cleavage site is changed to another amino acid to eliminate or alter the proteolytic cleavage at that site. In some embodiments the proteolytic cleavage is by a protease in the insect gut. In other embodiments the proteolytic cleavage is by a plant protease in the transgenic plant.

In some embodiments exemplary PHI-4 polypeptides are the polypeptides shown in Table 3, Table 4, Table 5, Table 6, Table 7, Table 8, and Table 9 and combinations of the amino substitutions thereof as well as amino acid deletions, and or insertions and fragments thereof.

In some embodiments the PHI-4 polypeptide is encoded by a nucleic acid molecule that hybridizes under stringent conditions to the nucleic acid molecule of SEQ ID NO: 1, SEQ ID NO: 7, SEQ ID NO: 11, SEQ ID NOs: 24-30, SEQ ID NOs. 1163-1505, and SEQ ID NOs. 1527-1535. Variants include polypeptides that differ in amino acid sequence due to mutagenesis. Variant proteins encompassed by the disclosure are biologically active, that is they continue to possess the desired biological activity (i.e. pesticidal activity) of the native protein. By "retains activity" is intended that the variant will have at least about 30%, at least about 50%, at least about 70% or at least about 80% of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In another aspect the PHI-4 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.* 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or Serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.* 275:9091-9094. The elucidation of the mechanism of protein splicing has led to a number of intein-based applications (Comb, et al., U.S. Pat. No. 5,496, 714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207:187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.* 120:5591-5592). For the application of inteins in plant transgenes see Yang, J, et al., (*Transgene Res* 15:583-593 (2006)) and Evans, et al., (*Annu. Rev. Plant Biol.* 56:375-392, (2005)).

In another aspect the PHI-4 polypeptide may be encoded by two separate genes where the intein of the precursor protein comes from the two genes, referred to as a split-intein and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g., homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the PHI-4 polypeptide and the 3' intein coding sequence is linked to the 5' end of the second fragment coding for the C-terminal part of the PHI-4 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA* 95(16):9226-31 and Evans, et al., (2000) *J Biol Chem* 275(13):9091-4 and of the DnaE gene from *Nostoc punctiforme* (see, Iwai, et al., (2006) *FEBS Lett* 580(7):1853-8). Non-split inteins have been artificially split in the laboratory to create new split inteins, for example: the artificially split Ssp DnaB intein (see, Wu, et al., (1998) *Biochim Biophys Acta* 1387:422-32) and split Sce VMA intein (see, Brenzel, et al., (2006) *Biochemistry* 45(6):1571-8) and an artificially split fungal mini-intein (see, Elleuche, et al., (2007) *Biochem Biophys Res Commun* 355(3):830-4). There are also intein databases available that catalogue known inteins (see, for example the online-database available at: bioinformatics.weizmann.ac.ilrpietro/inteins/Intein-stable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta* 1387: 422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol* 47:61-73) and hedgehog (Hog) auto-processing domains (the latter is combined with inteins when referred to as the Hog/intein superfamily or HINT family (see, Dassa, et al., (2004) *J Biol Chem.* 279 32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry* 46(1):322-30). Other such mixtures of disparate split intein partners have been shown to be unreactive one with another (see, Brenzel, et al., 2006 *Biochemistry* 45(6): 1571-8). However, it is within the ability of a person skilled in the relevant art to determine whether a particular pair of polypeptides is able to associate with each other to provide a functional intein, using routine methods and without the exercise of inventive skill.

In another aspect the PHI-4 polypeptide is a circular permuted variant. In certain embodiments the PHI-4 polypeptide is a circular permuted variant of the polypeptide of SEQ ID NO: 2, SEQ ID NO: 3, SEQ ID NO: 4, SEQ ID NOs: 51-1162, and SEQ ID NOs: 1518-1526. The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213. Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either amino acid deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted PHI-4 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted PHI-4 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another aspect fusion proteins are provided that include within its amino acid sequence an amino acid sequence comprising a PHI-4 polypeptide including but not limited to the polypeptide of SEQ ID NO: 2, SEQ ID NO: 3, SEQ ID NO: 4, SEQ ID NOs: 51-1162, and SEQ ID NOs: 1518-1526 and active fragments thereof.

In another aspect fusion proteins are provided comprising a PHI-4 polypeptide and a second pesticidal polypeptide such a Cry protein. Methods for design and construction of fusion proteins (and polynucleotides encoding same) are known to those of skill in the art. Polynucleotides encoding a PHI-4 polypeptide may be fused to signal sequences which will direct the localization of the PHI-4 polypeptide to particular compartments of a prokaryotic or eukaryotic cell and/or direct the secretion of the PHI-4 polypeptide of the embodiments from a prokaryotic or eukaryotic cell. For example, in *E. coli*, one may wish to direct the expression of the protein to the periplasmic space. Examples of signal sequences or proteins (or fragments thereof) to which the PHI-4 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit, and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the PHI-4 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the peptide transit plastid and the PHI-4 polypeptide to be targeted. In another embodiment, the fusion protein comprises the peptide transit plastid and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising a PHI-4 polypeptide, a pesticidal protein such as a cry protein, and an amino acid linker.

In some embodiments fusion proteins are provided represented by a formula selected from the group consisting of $$R^1\text{-}L\text{-}R^2,\ R^2\text{-}L\text{-}R^1,\ R^1\text{-}R^2 \text{ or } R^2\text{-}R^1$$

where $R^1$ is a PHI-4 polypeptide, $R^2$ is a pesticidal protein with a different but complementary activity to the PHI-4 polypeptide, including but not limited to cry proteins; a polypeptide that increases the solubility and/or stability of the PHI-4 polypeptide; or a transit peptide or leader sequence. The $R^1$ polypeptide is fused either directly or through a linker segment to the $R^2$ polypeptide. The term "directly" defines fusions in which the polypeptides are joined without a peptide linker. Thus L represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pill protein of the filamentous bacteriophages, e.g., bacteriophages M13 or fd (Schaller, et al., 1975). This region provides a long, flexible spacer region between two domains of the pill surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN from the multi-gene expression vehicle (MGEV), which is cleaved by vacuolar proteases as disclosed in US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Preferred linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

In another embodiment chimeric PHI-4 polypeptide are provided that are created through joining two or more portions of genes, which originally encoded separate insecticidal proteins from different species, to create a chimeric gene. The translation of the chimeric gene results in a single chimeric pesticidal polypeptide with regions, motifs or domains derived from each of the original polypeptides. In certain embodiments the chimeric protein comprises portions, motifs or domains of PHI-4 polypeptides in any combination. In certain embodiments the chimeric insecticidal polypeptide includes but not limited to the polypeptides of SEQ ID NO: 2, SEQ ID NO: 3, SEQ ID NO: 4, SEQ ID NOs: 51-1162, and SEQ ID NOs: 1518-1526.

It is recognized that DNA sequences may be altered by various methods, and that these alterations may result in DNA sequences encoding proteins with amino acid sequences different than that encoded by the wild-type (or native) pesticidal protein. These proteins may be altered in various ways including amino acid substitutions, amino acid deletions, amino acid truncations, and insertions of one or more amino acids, including up to 2, 3, 4, 5, 6, 7, 8, 9, 10, 15, 20, 25, 30, 35, 40, 45, 50, 55, 60, 65, 70, 75, 80, 85, 90, 100, 105, 110, 115, 120, 125, 130, 135, 140, 145, 150, 155 or more amino acid substitutions, amino acid deletions and/or insertions or combinations thereof compared to any one of SEQ ID NO: 35, SEQ ID NO: 2, SEQ ID NO: 3, SEQ ID NO: 4, SEQ ID NOs: 51-1162, and SEQ ID NOs: 1518-1526. In some embodiments a PHI-4 polypeptide comprises the deletion of 1, 2, 3, 4, 5, 6, 7, 8, 9, 10, 11, 12, 13, 14, 15, 16, 17, 18, 19, 20, 21, 22, 23, 24, 25, 26, 27, 28 or more amino acids from the C-terminus of the PHI-4 polypeptide relative to the amino acid position of SEQ ID NO: 2, SEQ ID NO: 3, SEQ ID NO: 4, SEQ ID NOs: 51-1162, and SEQ ID NOs: 1518-1526. Methods for such manipulations are generally known in the art. For example, amino acid sequence variants of a PHI-4 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a PHI-4 polypeptide to confer pesticidal activity may be improved by the use of such techniques upon the compositions of this disclosure.

For example, conservative amino acid substitutions may be made at one or more, predicted, nonessential amino acid residues. A "nonessential" amino acid residue is a residue that can be altered from the wild-type sequence of a PHI-4 polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+ 0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include amino acid insertions, amino acid deletions or amino acid alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

In specific embodiments, the substitution is an alanine for the native amino acid at the recited position(s). Also encompassed are the nucleic acid sequence(s) encoding the variant protein or polypeptide.

Variant nucleotide and amino acid sequences of the disclosure also encompass sequences derived from mutagenic and recombinogenic procedures such as DNA shuffling. With such a procedure, one or more different PHI-4 polypeptide coding regions can be used to create a new PHI-4 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291 and U.S. Pat. Nos. 5,605,793 and 5,837,458.

Domain swapping or shuffling is another mechanism for generating altered PHI-4 polypeptides. Domains may be swapped between PHI-4 polypeptides, resulting in hybrid or chimeric toxins with improved pesticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Antibodies

Antibodies to a PHI-4 polypeptide of the embodiments or to variants or fragments thereof, are also encompassed. Methods for producing antibodies are well known in the art (see, for example, Harlow and Lane, (1988) Antibodies: A Laboratory Manual, Cold Spring Harbor Laboratory, Cold Spring Harbor, N.Y.; U.S. Pat. No. 4,196,265).

A kit for detecting the presence of a PHI-4 polypeptide or detecting the presence of a nucleotide sequence encoding a PHI-4 polypeptide, in a sample is provided. In one embodiment, the kit provides antibody-based reagents for detecting the presence of a PHI-4 polypeptide in a tissue sample. In another embodiment, the kit provides labeled nucleic acid probes useful for detecting the presence of one or more polynucleotides encoding PHI-4 polypeptide(s). The kit is provided along with appropriate reagents and controls for carrying out a detection method, as well as instructions for use of the kit."

Receptor Identification and Isolation

Receptors to the PHI-4 polypeptide of the embodiments or to variants or fragments thereof, are also encompassed. Methods for identifying receptors are well known in the art (see, Hofmann, et. al., (1988) *Eur. J. Biochem.* 173:85-91; Gill, et al., (1995) *J. Biol. Chem.* 27277-27282) can be employed to identify and isolate the receptor that recognizes the PHI-4 polypeptides using the brush-border membrane vesicles from susceptible insects. In addition to the radioactive labeling method listed in the cited literatures, PHI-4 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled PHI-4 polypeptides can be incubated with blotted membrane of BBMV and labeled the PHI-4 polypeptides can be identified with the labeled reporters. Identification of protein band(s) that interact with the PHI-4 polypeptides can be detected by N-terminal amino acid gas phase sequencing or mass spectrometry based protein identification method (Patterson, (1998) 10(22):1-24, *Current Protocol in Molecular Biology* published by John Wiley & Son Inc). Once the protein is identified, the corresponding gene can be cloned from genomic DNA or cDNA library of the susceptible insects and binding affinity can be measured directly with the PHI-4 polypeptides. Receptor function for insecticidal activity by the PHI-4 polypeptides can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules and sequences. Further, the nucleotide constructs, nucleotide molecules and nucleotide sequences of the embodiments encompass all nucleotide constructs, molecules and sequences which can be employed in the methods of the embodiments for transforming plants including, but not limited to, those comprised of deoxyribonucleotides, ribonucleotides and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the PHI-4 polypeptide gene sequence to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct may also include a transcriptional enhancer sequence. As used herein, the term an "enhancer" refers to a DNA sequence which can stimulate promoter activity and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, herein incorporated by reference.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea maize* codon usage table can be also found at kazusa.or.jp/codon/cgi-bin/showcodon.cgi?species=4577, which can be accessed using the www prefix. Table 2 shows a maize optimal codon analysis (adapted from Liu H et al. *Mol Bio Rep* 37:677-684, 2010).

TABLE 2

| Amino Acid | Codon | High Count | RSCU | Low Count | RSCU |
|---|---|---|---|---|---|
| Phe | UUU | 115 | 0.04 | 2,301 | 1.22 |
|  | UUC* | 5,269 | 1.96 | 1,485 | 0.78 |
| Ser | UCU | 176 | 0.13 | 2,498 | 1.48 |
|  | UCC* | 3,489 | 2.48 | 1,074 | 0.63 |
|  | UCA | 104 | 0.07 | 2,610 | 1.54 |
|  | UCG* | 1,975 | 1.4 | 670 | 0.4 |
|  | AGU | 77 | 0.05 | 1,788 | 1.06 |
|  | AGC* | 2,617 | 1.86 | 1,514 | 0.89 |
| Leu | UUA | 10 | 0.01 | 1,326 | 0.79 |
|  | UUG | 174 | 0.09 | 2,306 | 1.37 |
|  | CUU | 223 | 0.11 | 2,396 | 1.43 |
|  | CUC* | 5,979 | 3.08 | 1,109 | 0.66 |
|  | CUA | 106 | 0.05 | 1,280 | 0.76 |
|  | CUG* | 5,161 | 2.66 | 1,646 | 0.98 |
| Pro | CCU | 427 | 0.22 | 1,900 | 1.47 |
|  | CCC* | 3,035 | 1.59 | 601 | 0.47 |
|  | CCA | 311 | 0.16 | 2,140 | 1.66 |
|  | CCG* | 3,846 | 2.02 | 513 | 0.4 |
| Ile | AUU | 138 | 0.09 | 2,388 | 1.3 |
|  | AUC* | 4,380 | 2.85 | 1,353 | 0.74 |
|  | AUA | 88 | 0.06 | 1,756 | 0.96 |
| Thr | ACU | 136 | 0.09 | 1,990 | 1.43 |
|  | ACC* | 3,398 | 2.25 | 991 | 0.71 |
|  | ACA | 133 | 0.09 | 2,075 | 1.5 |
|  | ACG* | 2,378 | 1.57 | 495 | 0.36 |
| Val | GUU | 182 | 0.07 | 2,595 | 1.51 |
|  | GUC* | 4,584 | 1.82 | 1,096 | 0.64 |
|  | GUA | 74 | 0.03 | 1,325 | 0.77 |
|  | GUG* | 5,257 | 2.08 | 1,842 | 1.07 |
| Ala | GCU | 629 | 0.17 | 3,063 | 1.59 |
|  | GCC* | 8,057 | 2.16 | 1,136 | 0.59 |
|  | GCA | 369 | 0.1 | 2,872 | 1.49 |
|  | GCG* | 5,835 | 1.57 | 630 | 0.33 |
| Tyr | UAU | 71 | 0.04 | 1,632 | 1.22 |
|  | UAC* | 3,841 | 1.96 | 1,041 | 0.78 |
| His | CAU | 131 | 0.09 | 1,902 | 1.36 |
|  | CAC* | 2,800 | 1.91 | 897 | 0.64 |
| Cys | UGU | 52 | 0.04 | 1,233 | 1.12 |
|  | UGC* | 2,291 | 1.96 | 963 | 0.88 |
| Gln | CAA | 99 | 0.05 | 2,312 | 1.04 |
|  | CAG* | 3,557 | 1.95 | 2,130 | 0.96 |
| Arg | CGU | 153 | 0.12 | 751 | 0.74 |
|  | CGC* | 4,278 | 3.25 | 466 | 0.46 |
|  | CGA | 92 | 0.07 | 659 | 0.65 |
|  | CGG* | 1,793 | 1.36 | 631 | 0.62 |
|  | AGA | 83 | 0.06 | 1,948 | 1.91 |
|  | AGG* | 1,493 | 1.14 | 1,652 | 1.62 |
| Asn | AAU | 131 | 0.07 | 3,074 | 1.26 |
|  | AAC* | 3,814 | 1.93 | 1,807 | 0.74 |
| Lys | AAA | 130 | 0.05 | 3,215 | 0.98 |
|  | AAG* | 5,047 | 1.95 | 3,340 | 1.02 |
| Asp | GAU | 312 | 0.09 | 4,217 | 1.38 |
|  | GAC* | 6,729 | 1.91 | 1,891 | 0.62 |
| Gly | GGU | 363 | 0.13 | 2,301 | 1.35 |
|  | GGC* | 7,842 | 2.91 | 1,282 | 0.75 |
|  | GGA | 397 | 0.15 | 2,044 | 1.19 |
|  | GGG* | 2,186 | 0.81 | 1,215 | 0.71 |

TABLE 2-continued

| Amino Acid | Codon | High Count | RSCU | Low Count | RSCU |
|---|---|---|---|---|---|
| Glu | GAA | 193 | 0.06 | 4,080 | 1.1 |
|  | GAG* | 6,010 | 1.94 | 3,307 | 0.9 |

Codon usage was compared using Chi squared contingency test to identify optimal codons.
Codons that occur significantly more often (P\0.01) are indicated with an asterisk.

A *Glycine max* codon usage table is shown in Table 3 and can also be found at kazusa.or.jp/codon/cgi-bin/showcodon.cgi?species=3847&aa=1&style=N, which can be accessed using the www prefix.

TABLE 3

| TTT | F | 21.2 | (10493) | TCT | S | 18.4 | (9107) |
|---|---|---|---|---|---|---|---|
| TTC | F | 21.2 | (10487) | TCC | S | 12.9 | (6409) |
| TTA | L | 9.2 | (4545) | TCA | S | 15.6 | (7712) |
| TTG | L | 22.9 | (11340) | TCG | S | 4.8 | (2397) |
| CTT | L | 23.9 | (11829) | CCT | P | 18.9 | (9358) |
| CTC | L | 17.1 | (8479) | CCC | P | 10.1 | (5010) |
| CTA | L | 8.5 | (4216) | CCA | P | 19.1 | (9461) |
| CTG | L | 12.7 | (6304) | CCG | P | 4.7 | (2312) |
| ATT | I | 25.1 | (12411) | ACT | T | 17.1 | (8490) |
| ATC | I | 16.3 | (8071) | ACC | T | 14.3 | (7100) |
| ATA | I | 12.9 | (6386) | ACA | T | 14.9 | (7391) |
| ATG | M | 22.7 | (11218) | ACG | T | 4.3 | (2147) |
| GTT | V | 26.1 | (12911) | GCT | A | 26.7 | (13201) |
| GTC | V | 11.9 | (5894) | GCC | A | 16.2 | (8026) |
| GTA | V | 7.7 | (3803) | GCA | A | 21.4 | (10577) |
| GTG | V | 21.4 | (10610) | GCG | A | 6.3 | (3123) |
| TAT | Y | 15.7 | (7779) | TGT | C | 8.1 | (3995) |
| TAC | Y | 14.9 | (7367) | TGC | C | 8.0 | (3980) |
| TAA | * | 0.9 | (463) | TGA | * | 1.0 | (480) |
| TAG | * | 0.5 | (263) | TGG | W | 13.0 | (6412) |
| CAT | H | 14.0 | (6930) | CGT | R | 6.6 | (3291) |
| CAC | H | 11.6 | (5759) | CGC | R | 6.2 | (3093) |
| CAA | Q | 20.5 | (10162) | CGA | R | 4.1 | (2018) |
| CAG | Q | 16.2 | (8038) | CGG | R | 3.1 | (1510) |
| AAT | N | 22.4 | (11088) | AGT | S | 12.6 | (6237) |
| AAC | N | 22.8 | (11284) | AGC | S | 11.3 | (5594) |
| AAA | K | 26.9 | (13334) | AGA | R | 14.8 | (7337) |
| AAG | K | 35.9 | (17797) | AGG | R | 13.3 | (6574) |
| GAT | D | 32.4 | (16040) | GGT | G | 20.9 | (10353) |
| GAC | D | 20.4 | (10097) | GGC | G | 13.4 | (6650) |
| GAA | E | 33.2 | (16438) | GGA | G | 22.3 | (11022) |
| GAG | E | 33.2 | (16426) | GGG | G | 13.0 | (6431) |

In some embodiments the recombinant nucleic acid molecule encoding a PHI-4 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

By "signal sequence" is intended a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are protolytically activated in the gut of the target pest (Chang, (1987) *Methods Enzymol.* 153:507-516). In some embodiments, the signal sequence is located in the native sequence or may be derived from a sequence of the embodiments. By "leader sequence" is intended any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research*, 78:249-264, 2003. In particular, table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CTPs comprising but not limited to, an N-terminal domain, a central domain or a C-terminal domain from a CTP from *Oryza sativa* 1-deoxy-D xyulose-5-Phosphate Synthase, *Oryza sativa*-Superoxide dismutase, *Oryza sativa*-soluble starch synthase, *Oryza sativa*-NADP-dependent Malic acid enzyme, *Oryza sativa*-Phospho-2-dehydro-3-deoxyheptonate Aldolase 2, *Oryza sativa*-L-Ascorbate peroxidase 5, *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type US Patent Application Publication 2012/0304336).

The PHI-4 polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4:645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc.*

*Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced PHI-4 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7):792-803; Hansen, et al., (1997) *Mol. Gen Genet.* 254(3):337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5):773-778; Lam, (1994) *Results Probl. Cell Differ.* 20:181-196; Orozco, et al., (1993) *Plant Mol* 23(6):1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed roIC and roID root-inducing genes of *Agrobacterium rhizogenes* (see, *Plant Science* (Limerick) 79(1):69-76). They concluded that enhancer and tissue-preferred DNA determinants are dissociated in those promoters. Teen, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2):343-350). The TR1' gene fused to nptII (neomycin phosphotransferase II) showed similar characteristics. Additional root-preferred promoters include the VfENOD-GRP3 gene promoter (Kuster, et al., (1995) *Plant Mol.* 29(4):759-772) and roIB promoter (Capana, et al., (1994) *Plant Mol.* 25(4):681-691. See also, U.S. Pat. Nos. 5,837,876; 5,750,386; 5,633,363; 5,459,252; 5,401,836; 5,110,732 and 5,023,179.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku, K. D. and Goldberg, R. B. *Plant Cell* 1:1079-1093, 1989), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608, 144; 5,604,121; 5,569,597; 5,466,785; 5,399,680; 5,268, 463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) *Ph.D. Thesis*, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is intended to mean presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods and virus-mediated methods.

"Stable transformation" is intended to mean that the nucleotide construct introduced into a plant integrates into the genome of the plant and is capable of being inherited by the progeny thereof. "Transient transformation" is intended to mean that a polynucleotide is introduced into the plant and does not integrate into the genome of the plant or a polypeptide is introduced into a plant. By "plant" is intended whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Bio/technology* 6:923-926) and Lec1 transformation (WO 2000/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, N.Y.), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the PHI-4 polypeptide or variants and fragments thereof directly into the plant or the introduction of the PHI-4 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107:775-784, all of which are herein incorporated by reference. Alternatively, the PHI-4 polypeptide polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired PHI-4 polypeptide. It is also recognized that such a viral polyprotein, comprising at least a portion of the amino acid sequence of a PHI-4 polypeptide of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367 and 5,316,931, herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves, and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (Carthamus tinctorius), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus effiotii*), ponderosa pine (*Pinus ponderosa*), lodgepole pine (*Pinus contorta*) and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactyls glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccineffia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive etc. Leguminous plants include beans and peas. Beans include guar, locust bean, fenugreek, soybean, garden beans, cowpea, mungbean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the PHI-4 polypeptide.

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene, and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the PHI-4 polypeptides disclosed herein, alone or stacked with one or more additional insect resistance traits can be stacked with one or more additional input traits (e.g., herbicide resistance, fungal resistance, virus resistance or stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:
1. Transgenes that Confer Resistance to Insects or Disease and that Encode:
(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262: 1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens*, 7:1-13), from *Pseudomonas protegens* strain CHA0 and Pf-5 (previously *fluorescens*) (Pechy-Tarr, (2008) *Environmental Microbiology* 10:2368-2386: GenBank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. No. 6,048,838, and U.S. Pat. No. 6,379,946; a PIP-1 polypeptide of U.S. Ser. No. 13/792,861; an AfIP-1A and/or AfIP-1B polypeptide of U.S. Ser. No. 13/800,233; a PHI-4 polypeptide of U.S. Ser. No. 13/839,702; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51, Cry 52, Cry 53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, Cry72, And Cry73 classes of δ-endotoxin genes and the *B. thuringiensis* cytolytic Cyt1 and Cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession #

BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession #126149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession #112419); Cry1Ab12 (Accession # AAC64003); Cry1Ab13 (Accession # AAN76494); Cry1Ab14 (Accession # AAG16877); Cry1Ab15 (Accession # AA013302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession #112418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AA039719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # AB020894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1 Be4 (Accession # HM070026); Cry1 Bf1 (Accession # CAC50778); Cry1Bf2 (Accession # AAQ52380); Cry1Bg1 (Accession # AA039720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession #176415); Cry1Da3 (Accession # HQ439784); Cry1Db1 (Accession # CAA80234); Cry1Db2 (Accession # AAK48937); Cry1Dc1 (Accession # ABK35074); Cry1 Ea1 (Accession # CAA37933); Cry1 Ea2 (Accession # CAA39609); Cry1 Ea3 (Accession # AAA22345); Cry1 Ea4 (Accession # AAD04732); Cry1 Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1 Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1 Fb2 (Accession # BAA25298); Cry1 Fb3 (Accession # AAF21767); Cry1Fb4 (Accession # AAC10641); Cry1Fb5 (Accession # AA013295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AA013756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession #

JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1 Ie2 (Accession # HM439636); Cry1 Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1 I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1 Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # AB183671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # AB030519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession #115475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession #134543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # AC144005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1

(Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession #I32932); Cry21Aa2 (Accession #I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession #I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # AC122625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BA144026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BA144022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118);

Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # AB114444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EA057254); Cry60Aa3 (Accession # EEM99278); Cry60Ba1 (Accession # GU810818); Cry60Ba2 (Accession # EA057253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BAI44028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # AD051070); Cry70Bb1 (Accession # EEL67276); Cry71Aa1 (Accession # JX025568); Cry72Aa1 (Accession # JX025569); and Cry73Aa (Accession # AEH76822).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of Cry proteins such as Cry1A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US20090144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US 2010/0005543; Axmi115 variants of US2013097728Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876 B1; 6,040,497; 5,804,425; 5,633,435; 5,145,783; 4,971,908; 5,312,910; 5,188,642; 5,094,945, 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and International Publications EP 1173580; WO 2001/66704; EP 1173581 and EP 1173582, which are incorporated herein by reference for this purpose. Glyphosate resistance is also imparted to plants that express a gene encoding a glyphosate oxidoreductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al., De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616 B1 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-52 and Acc1-53 genes described by Marshall, et al., (1992) *Theor. Appl. Genet.* 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) *Plant Cell* 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1 and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtl) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, various Ipa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particular to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. No. 6,197,561, U.S. Pat. No. 6,291,224, U.S. Pat. No. 6,391,348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that confers male fertility to be transcribed.

(A) Introduction of a deacetylase gene under the control of a tapetum-specific promoter and with the application of the chemical N—Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., (1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. No. 6,177,275 and U.S. Pat. No. 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. No. 6,794,560, U.S. Pat. No. 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events in Table 2A-1F.

TABLE 2A

*Helianthus annuus* Sunflower

| Event | Company | Description |
|---|---|---|
| X81359 | BASF Inc. | Tolerance to imidazolinone herbicides by selection of a naturally occurring mutant. |

TABLE 2B

*Medicago sativa* Alfalfa

| Event | Company | Description |
|---|---|---|
| J101, J163 | Monsanto Company and Forage Genetics International | Glyphosate herbicide tolerant alfalfa (lucerne) produced by inserting a gene encoding the enzyme 5-enolypyruvylshikimate-3-phosphate synthase (EPSPS) from the CP4 strain of *Agrobacterium tumefaciens*. |

TABLE 2C

Oryza sativa Rice

| Event | Company | Description |
|---|---|---|
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| IMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer CropScience (Aventis CropScience (AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 2D

Glycine max L. Soybean

| Event | Company | Description |
|---|---|---|
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega-6 desaturase encoding gene, gm-fad2-1 resulting in silencing of the endogenous omega-6 desaturase gene (FAD2-1). |
| DP356043 | Pioneer Hi-Bred International Inc. | Soybean event with two herbicide tolerance genes: glyphosate N-acetyltransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (GmFad2-1) encoding gene from soybean, which resulted in "silencing" of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. |
| GU262 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| MON87701 | Monsanto Company | Resistance to lepidopteran pests of soybean including velvetbean caterpillar (*Anticarsia gemmatalis*) and soybean looper (*Pseudoplusia includens*). |
| MON87701 × MON89788 | Monsanto Company | Glyphosate herbicide tolerance through expression of the EPSPS encoding gene from *A. tumefaciens* strain CP4, and resistance to lepidopteran pests of soybean including velvetbean caterpillar (*Anticarsia gemmatalis*) and soybean looper (*Pseudoplusia includens*) via expression of the Cry1Ac encoding gene from *B. thuringiensis*. |
| MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. |

TABLE 2D-continued

| | Glycine max L. Soybean | |
|---|---|---|
| Event | Company | Description |
| OT96-15 | Agriculture & Agri-Food Canada | Low linolenic acid soybean produced through traditional cross-breeding to incorporate the novel trait from a naturally occurring fan1 gene mutant that was selected for low linolenic acid. |
| W62, W98 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces hygroscopicus*. |

TABLE 2E

| | Zea mays L. Maize | |
|---|---|---|
| Event | Company | Description |
| 176 | Syngenta Seeds, Inc. | Insect-resistant maize produced by inserting the cry1Ab gene from *Bacillus thuringiensis* subsp. *kurstaki*. The genetic modification affords resistance to attack by the European corn borer (ECB). |
| 3751IR | Pioneer Hi-Bred International Inc. | Selection of somaclonal variants by culture of embryos on imidazolinone containing media. |
| 676, 678, 680 | Pioneer Hi-Bred International Inc. | Male-sterile and glufosinate ammonium herbicide tolerant maize produced by inserting genes encoding DNA adenine methylase and phosphinothricin acetyltransferase (PAT) from *Escherichia coli* and *Streptomyces viridochromogenes*, respectively. |
| B16 (DLL25) | Dekalb Genetics Corporation | Glufosinate ammonium herbicide tolerant maize produced by inserting the gene encoding phosphinothricin acetyltransferase (PAT) from *Streptomyces hygroscopicus*. |
| BT11 (X4334CBR, X4734CBR) | Syngenta Seeds, Inc. | Insect-resistant and herbicide tolerant maize produced by inserting the cry1Ab gene from *Bacillus thuringiensis* subsp. *kurstaki*, and the phosphinothricin N-acetyltransferase (PAT) encoding gene from *S. viridochromogenes*. |
| BT11 × GA21 | Syngenta Seeds, Inc. | Stacked insect resistant and herbicide tolerant maize produced by conventional cross breeding of parental lines BT11 (OECD unique identifier: SYN-BTO11-1) and GA21 (OECD unique identifier: MON-OOO21-9). |
| BT11 × MIR162 | Syngenta Seeds, Inc. | Stacked insect resistant and herbicide tolerant maize produced by conventional cross breeding of parental lines BT11 (OECD unique identifier: SYN-BTO11-1) and MIR162 (OECD unique identifier: SYN-IR162-4). Resistance to the European Corn Borer and tolerance to the herbicide glufosinate ammonium (Liberty) is derived from BT11, which contains the cry1Ab gene from *Bacillus thuringiensis* subsp. *kurstaki*, and the phosphinothricin N-acetyltransferase (PAT) encoding gene from *S. viridochromogenes*. Resistance to other lepidopteran pests, including *H. zea, S. frugiperda, A. ipsilon*, and *S. albicosta*, is derived from MIR162, which contains the vip3Aa gene from *Bacillus thuringiensis* strain AB88. |
| BT11 × MIR162 × MIR604 | Syngenta Seeds, Inc. | *Bacillus thuringiensis* Cry1Ab delta-endotoxin protein and the genetic material necessary for its production (via elements of vector pZO1502) in Event Bt11 corn (OECD Unique Identifier: SYN-BTO11-1) × *Bacillus thuringiensis* Vip3Aa20 insecticidal protein and the genetic material necessary for its production (via elements of vector pNOV1300) in Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-IR604-5). |

TABLE 2E-continued

Zea mays L. Maize

| Event | Company | Description |
|---|---|---|
| BT11 × MIR162 × MIR604 × GA21 | Syngenta Seeds, Inc. | Resistance to coleopteran pests, particularly corn rootworm pests (*Diabrotica* spp.) and several lepidopteran pests of corn, including European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*); tolerance to glyphosate and glufosinate-ammonium containing herbicides. |
| BT11 × MIR604 | Syngenta Seeds, Inc. | Stacked insect resistant and herbicide tolerant maize produced by conventional cross breeding of parental lines BT11 (OECD unique identifier: SYN-BTO11-1) and MIR604 (OECD unique identifier: SYN-IR6O5-5). Resistance to the European Corn Borer and tolerance to the herbicide glufosinate ammonium (Liberty) is derived from BT11, which contains the cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mcry3A gene from *Bacillus thuringiensis*. |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-IR6O5-5) and GA21 (OECD unique identifier: MON-OOO21-9). Resistance to the European Corn Borer and tolerance to the herbicide glufosinate ammonium (Liberty) is derived from BT11, which contains the cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mcry3A gene from *Bacillus thuringiensis*. Tolerance to glyphosate herbicide is derived from GA21 which contains a modified EPSPS gene from maize. |
| CBH-351 | Aventis CropScience | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus*. |
| DAS-06275-8 | DOW AgroSciences LLC | Lepidopteran insect resistant and glufosinate ammonium herbicide-tolerant maize variety produced by inserting the cry1F gene from *Bacillus thuringiensis* var *aizawai* and the phosphinothricin acetyltransferase (PAT) from *Streptomyces hygroscopicus*. |
| DAS-59122-7 | DOW AgroSciences LLC and Pioneer Hi-Bred International Inc. | Corn rootworm-resistant maize produced by inserting the cry34Ab1 and cry35Ab1 genes from *Bacillus thuringiensis* strain PS149B1. The PAT encoding gene from *Streptomyces viridochromogenes* was introduced as a selectable marker. |
| DAS-59122-7 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) with NK603 (OECD unique identifier: MON-OO6O3-6). Corn rootworm-resistance is derived from DAS-59122-7 which contains the cry34Ab1 and cry35Ab1 genes from *Bacillus thuringiensis* strain PS149B1. Tolerance to glyphosate herbicide is derived from NK603. |
| DAS-59122-7 × TC1507 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) and TC1507 (OECD unique identifier: DAS-O15O7-1) with NK603 (OECD unique identifier: MON-OO6O3-6). Corn rootworm-resistance is derived from DAS-59122-7 which contains the cry34Ab1 and cry35Ab1 genes from *Bacillus thuringiensis* strain PS149B1. Lepidopteran resistance and tolerance to glufosinate ammonium herbicide is derived from TC1507. Tolerance to glyphosate herbicide is derived from NK603. |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin acetyltransferase (PAT) from *Streptomyces hygroscopicus* |
| DK404SR | BASF Inc. | Somaclonal variants with a modified acetyl-CoA-carboxylase (ACCase) were selected by culture of embryos on sethoxydim enriched medium. |
| Event 3272 | Syngenta Seeds, Inc. | Maize line expressing a heat stable alpha-amylase gene amy797E for use in the dry-grind ethanol process. The phosphomannose isomerase gene from *E. coli* was used as a selectable marker. |
| Event 98140 | Pioneer Hi-Bred International Inc. | Maize event expressing tolerance to glyphosate herbicide, via expression of a modified bacterial glyphosate N-acetyltransferase, and ALS-inhibiting herbicides, vial expression of a modified form of the maize acetolactate synthase enzyme. |

TABLE 2E-continued

Zea mays L. Maize

| Event | Company | Description |
|---|---|---|
| EXP1910IT | Syngenta Seeds, Inc. (formerly Zeneca Seeds) | Tolerance to the imidazolinone herbicide, imazethapyr, induced by chemical mutagenesis of the acetolactate synthase (ALS) enzyme using ethyl methanesulfonate (EMS). |
| GA21 | Syngenta Seeds, Inc. (formerly Zeneca Seeds) | Introduction, by particle bombardment, of a modified 5-enolpyruvyl shikimate-3-phosphate synthase (EPSPS), an enzyme involved in the shikimate biochemical pathway for the production of the aromatic amino acids. |
| GA21 × MON810 | Monsanto Company | Stacked insect resistant and herbicide tolerant corn hybrid derived from conventional cross-breeding of the parental lines GA21 (OECD identifier: MON-OOO21-9) and MON810 (OECD identifier: MON-OO81O-6). |
| IT | Pioneer Hi-Bred International Inc. | Tolerance to the imidazolinone herbicide, imazethapyr, was obtained by in vitro selection of somaclonal variants. |
| LY038 | Monsanto Company | Altered amino acid composition, specifically elevated levels of lysine, through the introduction of the cordapA gene, derived from *Corynebacterium glutamicum*, encoding the enzyme dihydrodipicolinate synthase (cDHDPS). |
| MIR162 | Syngenta Seeds, Inc. | Insect-resistant maize event expressing a Vip3A protein from *Bacillus thuringiensis* and the *Escherichia coli* PMI selectable marker |
| MIR604 | Syngenta Seeds, Inc. | Corn rootworm resistant maize produced by transformation with a modified cry3A gene. The phosphomannose isomerase gene from *E. coli* was used as a selectable marker. |
| MIR604 × GA21 | Syngenta Seeds, Inc. | Stacked insect resistant and herbicide tolerant maize produced by conventional cross breeding of parental lines MIR604 (OECD unique identifier: SYN-IR6O5-5) and GA21 (OECD unique identifier: MON-OOO21-9). Corn rootworm-resistance is derived from MIR604 which contains the mcry3A gene from *Bacillus thuringiensis*. Tolerance to glyphosate herbicide is derived from GA21. |
| MON80100 | Monsanto Company | Insect-resistant maize produced by inserting the cry1Ab gene from *Bacillus thuringiensis* subsp. *kurstaki*. The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic cry1Ab gene. Glyphosate resistance via introduction of the bacterial version of a plant enzyme, 5-enolpyruvyl shikimate-3-phosphate synthase (EPSPS). |
| MON810 | Monsanto Company | Insect-resistant maize produced by inserting a truncated form of the cry1Ab gene from *Bacillus thuringiensis* subsp. *kurstaki* HD-1. The genetic modification affords resistance to attack by the European corn borer (ECB). |
| MON810 × LY038 | Monsanto Company | Stacked insect resistant and enhanced lysine content maize derived from conventional cross-breeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and MON88017 (OECD identifier: MON-88O17-3). European corn borer (ECB) resistance is derived from a truncated form of the cry1Ab gene from *Bacillus thuringiensis* subsp. *kurstaki* HD-1 present in MON810. Corn rootworm resistance is derived from the cry3Bb1 gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5-enolpyruvyl shikimate-3-phosphate synthase (EPSPS), an enzyme involved in the shikimate biochemical pathway for the production of the aromatic amino acids. |
| MON863 | Monsanto Company | Corn root worm resistant maize produced by inserting the cry3Bb1 gene from *Bacillus thuringiensis* subsp. *kumamotoensis*. |
| MON863 × MON810 | Monsanto Company | Stacked insect resistant corn hybrid derived from conventional cross-breeding of the parental lines MON863 (OECD identifier: MON-OO863-5) and MON810 (OECD identifier: MON-OO81O-6) |
| MON863 × MON810 × NK603 | Monsanto Company | Stacked insect resistant and herbicide tolerant corn hybrid derived from conventional cross-breeding of the stacked hybrid MON-OO863-5 × MON-OO81O-6 and NK603 (OECD identifier: MON-OO6O3-6). |

TABLE 2E-continued

Zea mays L. Maize

| Event | Company | Description |
|---|---|---|
| MON863 × NK603 | Monsanto Company | Stacked insect resistant and herbicide tolerant corn hybrid derived from conventional cross-breeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the cry3Bb1 gene from *Bacillus thuringiensis* subspecies *kumamotoensis* strain EG4691. Glyphosate tolerance derived by inserting a 5-enolpyruvylshikimate-3-phosphate synthase (EPSPS) encoding gene from *Agrobacterium tumefaciens* strain CP4. |
| MON89034 | Monsanto Company | Maize event expressing two different insecticidal proteins from *Bacillus thuringiensis* providing resistance to number of lepidopteran pests. |
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two cry genes present in MON89043. Corn rootworm resistance is derived from a single cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89O34-3) with NK603 (OECD unique identifier: MON-OO6O3-6). Resistance to Lepidopteran insects is derived from two cry genes present in MON89043. Tolerance to glyphosate herbicide is derived from NK603. |
| MON89034 × TC1507 × MON88017 × DAS-59122-7 | Monsanto Company and Mycogen Seeds c/o Dow AgroSciences LLC | Stacked insect resistant and herbicide tolerant maize produced by conventional cross breeding of parental lines: MON89034, TC1507, MON88017, and DAS-59122. Resistance to the above-ground and below-ground insect pests and tolerance to glyphosate and glufosinate-ammonium containing herbicides. |
| MS3 | Bayer CropScience (Aventis CropScience (AgrEvo)) | Male sterility caused by expression of the barnase ribonuclease gene from *Bacillus amyloliquefaciens*; PPT resistance was via PPT-acetyltransferase (PAT). |
| MS6 | Bayer CropScience (Aventis CropScience (AgrEvo)) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikimate biochemical pathway for the production of the aromatic amino acids. |
| NK603 × MON810 | Monsanto Company | Stacked insect resistant and herbicide tolerant corn hybrid derived from conventional cross-breeding of the parental lines NK603 (OECD identifier: MON-OO6O3-6) and MON810 (OECD identifier: MON-OO81O-6). |
| NK603 × T25 | Monsanto Company | Stacked glufosinate ammonium and glyphosate herbicide tolerant maize hybrid derived from conventional cross-breeding of the parental lines NK603 (OECD identifier: MON-OO6O3-6) and T25 (OECD identifier: ACS-ZM003-2). |
| T14, T25 | Bayer CropScience (Aventis CropScience (AgrEvo)) | Glufosinate herbicide tolerant maize produced by inserting the phosphinothricin N-acetyltransferase (PAT) encoding gene from the aerobic actinomycete *Streptomyces viridochromogenes*. |

TABLE 2E-continued

Zea mays L. Maize

| Event | Company | Description |
|---|---|---|
| T25 × MON810 | Bayer CropScience (Aventis CropScience (AgrEvo)) | Stacked insect resistant and herbicide tolerant corn hybrid derived from conventional cross-breeding of the parental lines T25 (OECD identifier: ACS-ZMOO3-2) and MON810 (OECD identifier: MON-OO81O-6). |
| TC1507 | Mycogen (c/o Dow AgroSciences); Pioneer (c/o DuPont) | Insect-resistant and glufosinate ammonium herbicide tolerant maize produced by inserting the cry1F gene from *Bacillus thuringiensis* var. *aizawai* and the phosphinothricin N-acetyltransferase encoding gene from *Streptomyces viridochromogenes*. |
| TC1507 × DAS-59122-7 | DOW AgroSciences LLC and Pioneer Hi-Bred International Inc. | Stacked insect resistant and herbicide tolerant maize produced by conventional cross breeding of parental lines TC1507 (OECD unique identifier: DAS-O15O7-1) with DAS-59122-7 (OECD unique identifier: DAS-59122-7). Resistance to lepidopteran insects is derived from TC1507 due the presence of the cry1F gene from *Bacillus thuringiensis* var. *aizawai*. Corn rootworm-resistance is derived from DAS-59122-7 which contains the cry34Ab1 and cry35Ab1 genes from *Bacillus thuringiensis* strain PS149B1. Tolerance to glufosinate ammonium herbicide is derived from TC1507 from the phosphinothricin N-acetyltransferase encoding gene from *Streptomyces viridochromogenes*. |
| TC1507 × NK603 | DOW AgroSciences LLC | Stacked insect resistant and herbicide tolerant corn hybrid derived from conventional cross-breeding of the parental lines 1507 (OECD identifier: DAS-O15O7-1) and NK603 (OECD identifier: MON-OO6O3-6). |

TABLE 2F

Triticum aestivum Wheat

| Event | Company | Description |
|---|---|---|
| AP205CL | BASF Inc. | Selection for a mutagenized version of the enzyme acetohydroxyacid synthase (AHAS), also known as acetolactate synthase (ALS) or acetolactate pyruvate-lyase. |
| AP602CL | BASF Inc. | Selection for a mutagenized version of the enzyme acetohydroxyacid synthase (AHAS), also known as acetolactate synthase (ALS) or acetolactate pyruvate-lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate-lyase. |
| BW7 | BASF Inc. | Tolerance to imidazolinone herbicides induced by chemical mutagenesis of the acetohydroxyacid synthase (AHAS) gene using sodium azide. |
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |
| SWP965001 | Cyanamid Crop Protection | Selection for a mutagenized version of the enzyme acetohydroxyacid synthase (AHAS), also known as acetolactate synthase (ALS) or acetolactate pyruvate-lyase. |
| Teal 11A | BASF Inc. | Selection for a mutagenized version of the enzyme acetohydroxyacid synthase (AHAS), also known as acetolactate synthase (ALS) or acetolactate pyruvate-lyase. |
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |

Other events with regulatory approval are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more of the PHI-4 polypeptides or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al. (1998) *Plant J.* 16:651-659 and Gura, (2000) *Nature* 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication Number WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression see, Wesley, et al., (2003) *Methods in Molecular Biology, Plant Functional Genomics: Methods and Protocols* 236:273-286.

A construct where the stem is formed by at least 30 nucleotides from a gene to be suppressed and the loop is formed by a random nucleotide sequence has also effectively been used for suppression (WO 1999/61632).

The use of poly-T and poly-A sequences to generate the stem in the stem-loop structure has also been described (WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication Number WO 2002/00904.

RNA interference refers to the process of sequence-specific post-transcriptional gene silencing in animals mediated by short interfering RNAs (siRNAs) (Fire, et al., (1998) *Nature* 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) *Trends Genet.* 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) *Nature* 409:363). Short interfering RNAs derived from dicer activity are typically about 21 to about 23 nucleotides in length and comprise about 19 base pair duplexes (Elbashir, et al., (2001) *Genes Dev.* 15:188). Dicer has also been implicated in the excision of 21- and 22-nucleotide small temporal RNAs (stRNAs) from precursor RNA of conserved structure that are implicated in translational control (Hutvagner, et al., (2001) *Science* 293:834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) *Genes Dev.* 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) *Science* 297:1818-1819; Volpe, et al., (2002) *Science* 297:1833-1837; Jenuwein, (2002) *Science* 297:2215-2218; and Hall, et al., (2002) *Science* 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US 2009/0188008.

As used herein, a "suppressor enhancer element" comprises a polynucleotide comprising the target sequence to be suppressed or an active fragment or variant thereof. It is recognize that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts, and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US 2011/0301223 and US 2009/0192117.

Some embodiments relate to down-regulation of expression of target genes in insect pest species by interfering ribonucleic acid (RNA) molecules. WO 2007/074405 describes methods of inhibiting expression of target genes in invertebrate pests including Colorado potato beetle. WO 2005/110068 describes methods of inhibiting expression of target genes in invertebrate pests including in particular Western corn rootworm as a means to control insect infestation. Furthermore, WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein; and an insect Tbp-1 such as Tat-binding protein. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art. See, for example U.S. Pat. No. 5,039,523 and EP 0480762A2.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the PHI-4 polypeptide, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*, fungi, particularly yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Pseudomonas chlororaphis, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*. Of particular interest are the pigmented microorganisms. Host organisms of particular interest include yeast, such as *Rhodotorula* spp., *Aureobasidium* spp., *Saccharomyces* spp. (such as *S. cerevisiae*), *Sporobolomyces* spp., phylloplane organisms such as *Pseudomonas* spp. (such as *P. aeruginosa, P. fluorescens, P. chlororaphis*), *Erwinia* spp., and *Flavobacterium* spp., and other such organisms, including *Agrobacterium tumefaciens, E. coli, Bacillus subtilis, Bacillus cereus* and the like.

Genes encoding the PHI-4 polypeptides of the embodiments can be introduced into microorganisms that multiply on plants (epiphytes) to deliver PHI-4 polypeptides to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman, et al., (1991) *Appl. Environ. Microbiol.* 56:713-718). Genes encoding the PHI-4 polypeptides of the embodiments can be introduced into a root-colonizing *Bacillus cereus* by standard methods known in the art.

Genes encoding PHI-4 polypeptides can be introduced, for example, into the root-colonizing *Bacillus* by means of electro transformation. Specifically, genes encoding the PHI-4 polypeptides can be cloned into a shuttle vector, for example, pHT3101 (Lerecius, et al., (1989) *FEMS Microbiol. Letts.* 60:211-218. The shuttle vector pHT3101 containing the coding sequence for the particular PHI-4 polypeptide gene can, for example, be transformed into the root-colonizing *Bacillus* by means of electroporation (Lerecius, et al., (1989) *FEMS Microbiol. Letts.* 60:211-218).

Expression systems can be designed so that PHI-4 polypeptides are secreted outside the cytoplasm of gram-negative bacteria, such as *E. coli*, for example. Advantages of having PHI-4 polypeptides secreted are: (1) avoidance of potential cytotoxic effects of the PHI-4 polypeptide expressed; and (2) improvement in the efficiency of purification of the PHI-4 polypeptide, including, but not limited to, increased efficiency in the recovery and purification of the protein per volume cell broth and decreased time and/or costs of recovery and purification per unit protein.

PHI-4 polypeptides can be made to be secreted in *E. coli*, for example, by fusing an appropriate *E. coli* signal peptide to the amino-terminal end of the PHI-4 polypeptide. Signal peptides recognized by *E. coli* can be found in proteins already known to be secreted in *E. coli*, for example the OmpA protein (Ghrayeb, et al., (1984) *EMBO J*, 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud, et al., (1987) *Meth. Enzymol.* 153: 492).

PHI-4 polypeptides of the embodiments can be fermented in a bacterial host and the resulting bacteria processed and used as a microbial spray in the same manner that Bt strains have been used as insecticidal sprays. In the case of a PHI-4 polypeptide that is secreted from *Bacillus*, the secretion signal is removed or mutated using procedures known in the art. Such mutations and/or deletions prevent secretion of the PHI-4 polypeptide into the growth medium during the fermentation process. The PHI-4 polypeptides are retained within the cell, and the cells are then processed to yield the encapsulated PHI-4 polypeptides. Any suitable microorganism can be used for this purpose. *Pseudomonas* has been used to express Bt toxins as encapsulated proteins and the resulting cells processed and sprayed as an insecticide (Gaertner, et al., (1993), in: *Advanced Engineered Pesticides*, ed. Kim).

Alternatively, the PHI-4 polypeptides are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated PHI-4 polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agrochemical composition that contains at least one of the PHI-4 polypeptides produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, dipteran, heteropteran, nematode, hemiptera or coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. By "pesticidally-effective amount" is intended an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions, and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, Fluacrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, loxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoximmethyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-)Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2 (5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran, Organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinone or combinations thereof.

In some embodiments the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks, and the like. Insect pests include insects selected from the orders Coleoptera, Diptera, Hymenoptera, *Lepidoptera*, Mallophaga, Homoptera, Hemiptera, Orthroptera, Thysanoptera, Dermaptera, Isoptera, Anoplura, Siphonaptera, Trichoptera, etc., particularly *Lepidoptera*, and Hemiptera.

Those skilled in the art will recognize that not all compounds are equally effective against all pests. Compounds of the embodiments display activity against insect pests, which may include economically important agronomic, forest, greenhouse, nursery, ornamentals, food and fiber, public and animal health, domestic and commercial structure, household and stored product pests.

Larvae of the order *Lepidoptera* include, but are not limited to, armyworms, cutworms, loopers, and heliothines in the family Noctuidae *Spodoptera frugiperda* JE Smith (fall armyworm); *S. exigua* Hübner (beet armyworm); *S.*

*litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira* (Xylomyges) *curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms, and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rosslerstamm (summer fruit *tortrix* moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order *Lepidoptera* include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori* Linnaeus (Silkworm); *Buccu-*
*latrix thurberiella* Busck (cotton leaf perforator); *Collas eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail, orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval & Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenée; *Malacosoma* spp. and *Orgyia* spp.

Of interest are larvae and adults of the order Coleoptera including weevils from the families Anthribidae, Bruchidae, and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles, and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith & Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculate* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly); and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp.; and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds); and other Brachycera, mosquitoes *Aedes* spp.; *Anopheles* spp.; *Culex* spp.; black flies *Prosimulium* spp.; *Simulium* spp.; biting midges, sand flies, sciarids, and other Nematocera.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, *phylloxera* from the family Phylloxeridae, mealybugs from the family Pseudococcidae, scales from the families Asterolecanidae, Coccidae, Dactylopiidae, Diaspididae, Eriococcidae, Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae, and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid); and *T. citricida* Kirkaldy (brown citrus aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrotestes quadrilineatus* Forbes (aster leafhopper); *Nephotettix cinticeps* Uhler (green leafhopper); N. nigropictus Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear *psylla*); *Trioza diospyri* Ashmead (persimmon *psylla*).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; *Tinidae* spp.; *Blostomatidae* spp.; *Reduviidae* spp.; and *Cimicidae* spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T.*

*turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e. dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick); and scab and itch mites in the families Psoroptidae, Pyemotidae, and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch & Mulaik (brown recluse spider); and the *Latrodectus mactans* Fabricius (black widow spider); and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (Bagrada Bug)), the family Plataspidae (*Megacopta cribraria*-Bean plataspid), and the family Cydnidae (*Scaptocoris castanea*-Root stink bug); and *Lepidoptera* species including but not limited to: diamond-back moth, e.g., *Helicoverpa zea* Boddie; soybean looper, e.g., *Pseudoplusia includens* Walker; and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C.D.S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, *penicillium*, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, *trichoderma*, trifloxystrobin, triticonazole and/or zinc. PCNB seed coat refers to EPA registration number 00293500419, containing quintozen and terrazole. TCMTB refers to 2-(thiocyanomethylthio)benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Inhibiting Growth or Killing an Insect Pest and Controlling an Insect Population In some embodiments methods are provided for inhibiting growth or killing an insect pest, comprising contacting the insect pest with an insecticidally-effective amount of a recombinant PHI-4 polypeptide. In some embodiments methods are provided for inhibiting growth or killing an insect pest, comprising contacting the insect pest with an insecticidally-effective amount of a recombinant pesticidal protein of SEQ ID NO: 2, SEQ ID NO: 3, SEQ ID NO: 4, SEQ ID NOs: 51-1162, and SEQ ID NOs: 1518-1526 or a variant thereof.

In some embodiments methods are provided for controlling an insect pest population, comprising contacting the insect pest population with an insecticidally-effective amount of a recombinant PHI-4 polypeptide. In some embodiments methods are provided for controlling an insect pest population, comprising contacting the insect pest population with an insecticidally-effective amount of a recombinant pesticidal protein of SEQ ID NO: 2, SEQ ID NO: 3, SEQ ID NO: 4, SEQ ID NOs: 51-1162, and SEQ ID NOs: 1518-1526 or a variant thereof. As used herein, by "controlling a pest population" or "controls a pest" is intended any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population with an insecticidally-effective amount of a recombinant PHI-4 polypeptide. In some embodiments methods are provided for controlling an insect pest population resistant to a pesticidal protein, comprising contacting the insect pest population with an insecticidally-effective amount of a recombinant pesticidal protein of SEQ ID NO: 2, SEQ ID NO: 3, SEQ ID NO: 4, SEQ ID NOs: 51-1162, and SEQ ID NOs: 1518-1526 or a variant thereof.

In some embodiments methods are provided for protecting a plant from an insect pest, comprising expressing in the plant or cell thereof a recombinant PHI-4 polypeptide. In some embodiments methods are provided for protecting a plant from an insect pest, comprising expressing in the plant or cell thereof a recombinant pesticidal protein of SEQ ID NO: 2, SEQ ID NO: 3, SEQ ID NO: 4, SEQ ID NOs: 51-1162, and SEQ ID NOs: 1518-1526 or variants thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush for example, outlines two-toxin strategies, also called "pyramiding" or "stacking," for management of insecticidal transgenic crops. (The Royal Society. Phil. Trans. R. Soc. Lond. B. (1998) 353:777-1786). Stacking or pyramiding of two different proteins each effective against the target pests and with little or no cross-resistance can allow for use of a smaller refuge. The U.S. Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the PHI-4 polypeptides of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Coleoptera insect infestation(s) in a transgenic plant that promote insect resistance management, comprising expressing in the plant at least two different insecticidal proteins having different modes of action.

In some embodiments the methods of controlling Coleoptera insect infestation in a transgenic plant and promoting insect resistance management the at least one of the insecticidal proteins comprise a PHI-4 polypeptide insecticidal to insects in the order Coleoptera.

In some embodiments the methods of controlling Coleoptera insect infestation in a transgenic plant and promoting insect resistance management the at least one of the insecticidal proteins comprises a protein of SEQ ID NO: 2, SEQ ID NO: 3, SEQ ID NO: 4, SEQ ID NOs: 51-1162, and SEQ ID NOs: 1518-1526 or variants thereof, insecticidal to insects in the order Coleoptera.

In some embodiments the methods of controlling Coleoptera insect infestation in a transgenic plant and promoting insect resistance management comprise expressing in the transgenic plant a PHI-4 polypeptide and a cry protein insecticidal to insects in the order Coleoptera having different modes of action.

In some embodiments the methods of controlling Coleoptera insect infestation in a transgenic plant and promoting insect resistance management comprise in the transgenic plant a protein of SEQ ID NO: 2, SEQ ID NO: 3, SEQ ID NO: 4, SEQ ID NOs: 51-1162, and SEQ ID NOs: 1518-1526 or variants thereof and a cry protein insecticidal to insects in the order Coleoptera having different modes of action.

Also provided are methods of reducing likelihood of emergence of Coleoptera insect resistance to transgenic plants expressing in the plants insecticidal proteins to control the insect species, comprising expression of a PHI-4 polypeptide insecticidal to the insect species in combination with a second insecticidal protein to the insect species having different modes of action.

Also provided are methods of reducing likelihood of emergence of Coleoptera insect resistance to transgenic plants expressing in the plants insecticidal proteins to control the insect species, comprising expression of a protein of SEQ ID NO: 2, SEQ ID NO: 3, SEQ ID NO: 4, SEQ ID NOs: 51-1162, and SEQ ID NOs: 1518-1526 or variants thereof, insecticidal to the insect species in combination with a second insecticidal protein to the insect species having different modes of action.

Also provided are means for effective Coleoptera insect resistance management of transgenic plants, comprising co-expressing at high levels in the plants two or more insecticidal proteins toxic to Coleoptera insects but each exhibiting a different mode of effectuating its inhibiting growth or killing activity, wherein the two or more insecticidal proteins comprise a PHI-4 polypeptide and a cry protein. Also provided are means for effective Coleoptera insect resistance management of transgenic plants, comprising co-expressing at high levels in the plants two or more insecticidal proteins toxic to Coleoptera insects but each exhibiting a different mode of effectuating its inhibiting growth or activity, wherein the two or more insecticidal proteins comprise a protein of SEQ ID NO: 2, SEQ ID NO: 3, SEQ ID NO: 4, SEQ ID NOs: 51-1162, and SEQ ID NOs: 1518-1526 or variants thereof and a cry protein.

In addition, methods are provided for obtaining regulatory approval for planting or commercialization of plants expressing proteins insecticidal to insects in the order Coleoptera, comprising the step of referring to, submitting or relying on insect assay binding data showing that the PHI-4 polypeptide does not compete with binding sites for cry proteins in such insects. In addition, methods are provided for obtaining regulatory approval for planting or commercialization of plants expressing proteins insecticidal to insects in the order Coleoptera, comprising the step of referring to, submitting or relying on insect assay binding data showing that the protein of SEQ ID NO: 2, SEQ ID NO: 3, SEQ ID NO: 4, SEQ ID NOs: 51-1162, and SEQ ID NOs: 1518-1526 or variant thereof does not compete with binding sites for cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a lepidopteran, coleopteran, dipteran, hemipteran or nematode pest, and the field is infested with a lepidopteran, hemipteran, coleopteran, dipteran or nematode pest.

As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a PHI-4 polypeptide disclosed herein. Expression of the PHI-4 polypeptide results in a reduced ability of a pest to infest or feed on the plant, thus improving plant yield.

These and other changes may be made to the disclosure in light of the above detailed description. In general, in the following claims, the terms used should not be construed to limit the disclosure to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

The following examples are put forth so as to provide those of ordinary skill in the art with a complete disclosure and description of how to make and use the subject disclosure, and are not intended to limit the scope of what is regarded as the invention. Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

EXPERIMENTALS

Example 1: Generating PHI-4 Genes

Polynucleotides having single codon substitutions compared to the PHI-4 polypeptide of SEQ ID NO: 1 were generated. As described in the examples below, the corresponding PHI-4 polypeptides were expressed, purified and assayed for WCRW insecticidal activity in order to assess the corresponding activity diversity. A reverse mutagenesis primer and a complementary forward mutagenesis primer were designed to create the desired amino acid substitution(s) at the site(s) of interest. Typically the mutagenesis primer was between 30 to 45 bases in length with two or more bases, usually 10 to 15, on both sides of the site of interest. In the case of saturation mutagenesis, degenerated primers that cover all possible amino acid residues were used. Unless otherwise noted, the mutagenic reactions were carried out using Agilent's QuikChange™ Lightening Site-Directed Mutagenesis kit. Materials provided in the kit are QuikChange™ Lightening Enzyme, 10× QuikChange™ Lightning Buffer, dNTP mix, QuikSolution™ reagent and Dpn1 restriction enzyme according to the manufactures directions.

PCR amplifications were typically carried out with Expand™ High Fidelity PCR system (Roche, Switzerland) in 50 ul containing 50-100 ng templates, 0.4-2 µM primer pair, 200 µM dNTPs and 2 Units of DNA polymerase. The mutagenesis reaction was initiated by pre-heating the reaction mixture to 94° C. for 3 min, followed by 16 cycles of the following cycling program: 94° C. for 1 min, 52° C. for 1 min and 68° C. for 8, 12, 16 or 24 min according to the length of template. The mutagenesis reaction was completed by incubation at 68° C. for 1 h. The PCR-amplification products were evaluated by agarose gel electrophoresis. The PCR products were purified by QIAquick™ PCR purification kit (Qiagen, Germany) and further treated with the restriction enzyme Dpn1. An aliquot of 1 µl of this PCR product was typically transformed into BL21(DE3) cells and inoculated on Luria-Bertani (LB) plate containing 100 µg/ml ampicillin. About 10 colonies in the case of single amino acid mutation or 48 or more colonies for saturation mutagenesis were selected and plasmid DNA was isolated for sequencing. Two step sequencing was used, first for specific mutation site(s) with one sequencing primer followed by full length sequence confirmation with multiple sequencing primers.

Example 2: Purification of MBP::PHI-4 Fusion Polypeptides

Polynucleotides encoding PHI-4 polypeptides were expressed in a modified pMAL vector (New England Bio Lab) as a fusion (i.e. MBP::PHI-4; SEQ ID NO: 6) with MBP (maltose binding protein). The pMAL vector was modified to attach a 6× His tag to the N-terminus of MBP. In order to clone the polynucleotide encoding the MBP::PHI-4 fusion protein (SEQ ID NO: 6), Sph1 and BamH1 sites were engineered in the vector at the cloning site. The polynucleotide (SEQ ID NO: 1) encoding the PHI-4 polypeptide (SEQ ID NO: 2) was amplified with a forward primer (SEQ ID NO: 32) overlapping the Sph1 site and a reverse primer (SEQ ID NO: 33) overlapping the BamH1 site. This PCR product was digested with Sph1 and BamH1 and cloned into pMAL that was precut with the same enzymes. The forward primer was designed such that polynucleotides encoding both MBP and PHI-4 polypeptide (SEQ ID NO: 2) within the MBP::PHI-4 gene (SEQ ID NO: 5) were ligated in frame. The plasmid containing the polynucleotide (SEQ ID NO: 5) encoding the MBP::PHI-4 polypeptide (SEQ ID NO: 6) was transformed into *E. coli* BL21(DE3) cells. The BL21(DE3) cells were grown in MagicMedia™ (Life Technologies) in either 96 deep well plates or flasks in a shaker running at 250 rpm at 37° C. for 8 hrs. followed by 16° C. for 48-60 hrs. During the 16° C. incubation, the MBP::PHI-4 polypeptide fusion protein accumulated in the BL21(DE3) cells as a soluble protein.

In order to purify the MBP::PHI-4 fusion protein (SEQ ID NO: 6), the *E. coli* cells were harvested by centrifugation and treated in a lysozyme solution consisting of 2 mg/ml lysozyme in 50 ml sodium phosphate buffer at pH 8.0 containing 300 mM NaCl, 2 U/ml endonuclease (Epicentre) and 5 mM $MgCl_2$ for 3 hrs. at 37° C. with gentle shaking. The lysozyme treated *E. coli* cells were then disrupted with 1% Triton X100 and clear lysate containing the MBP::PHI-4 proteins were prepared by centrifugation at 4000 rpm, 30 min (96 well plates) or 9000 rpm (flask produced samples). His tagged MBP-PHI-4 polypeptide fusion proteins were purified from the clear lysates by affinity chromatography using NiNTA agarose (catalog #30450; Qiagen) following the manufacturer's standard procedure. For high throughput protein purification, Pall 96 deep well filter plates (Pall Corporation; Catalogue #5051) were used for the affinity chromatography. The purified MPB::PHI-4 polypeptide fusion protein was eluted from NiNTA agarose and passed through Sephadex G25 to change the phosphate buffer to 25 mM HEPES-NaOH, pH 8 and used in insect bioassays for determining the insecticidal activity against Western Corn Rootworm (WCRW). Calipar GXII capillary electrophoresis with a protein chip (Agilent; catalogue #P/N760499) was used to determine the MPB::PHI-4 polypeptide concentrations. The protein analysis was repeated at least 3 times until the final concentration was within the predetermined deviation (less than 10%). Unless otherwise noted, the PHI-4 polypeptides disclosed herein were expressed, purified and assayed for WCRW insecticidal activity as maltose binding protein fusions (i.e. MBP::PHI-4; SEQ ID NO: 6) as described above.

Example 3: Determination of WCRW Insecticidal Activity of MBP::PHI-4 (SEQ ID NO: 6) and MBP::PHI-4-SFR12-004 (SEQ ID NO: 31) Polypeptides The activity of MBP::PHI-4 (SEQ ID NO: 6) and MBP::PHI-4-SFR12-004 (SEQ ID NO: 31; Example 8) polypeptides against WCRW (western corn rootworm, *Diabrotica virgifera virgifera*) was determined in an artificial diet feeding assay essentially as described by Cong, R. et al. (Proceedings of the 4th Pacific Rim Conferences on Biotechnology of *Bacillus thuringiensis* and its environmental impact, pp. 118-123, ed. by R. J. Akhurst, C. E. Beard and P. Hughes, published in 2002, Canberra, Australia). The assays were conducted on an artificial diet containing dilutions of these polypeptides. The MBP::PHI-4-SFR12-004 polypeptide fusion (SEQ ID NO: 31) and MBP::PHI-4 (SEQ ID NO: 6) fusions were prepared as above, and 10 μL of protein samples were mixed with 50 μL of molten (40-50° C.) artificial insect diet especially prepared for *Diabrotica* sp. with low temperature melting agarose, whey protein and wheat germ. The diet-PHI-4 polypeptide mixture was placed in each well of a 96 well micro-titer plate. Four or more neonate WCRW larvae were placed in each well to feed for 4 days at 25° C. The response of insects towards the proteins was scored using a 0-3 numerical scoring system based on the size and mortality of the larvae in each well. If no response (or normal growth) was seen, a score of 0 was given. When the growth was slightly retarded, a score of 1 was given. A score of 2 meant that the larvae were severely retarded in growth (close to neonate size). A score of 3 meant death to all the larvae in the well. The percent response (% Response) for each treatment was calculated by dividing the total score, a sum of scores from replicated wells for each treatment, by the total highest possible scores and multiplying by 100 to yield "% Response". For example, if one treatment (one sample, one dose) had 6 replicated wells, the total highest possible score would be 3×6=18. An observed set of scores of 3, 2, 2, 3, 2, 2 for six wells at a given dose for a given variant would result in (14/18)×100=78% Response.

Fast Activity Evaluation (FAE) Analysis:

The PHI-4 polypeptides at two concentrations were assayed along with 4 doses (two-fold dilutions bracketing the EC50) of the reference MBP::PHI-4 fusion protein (SEQ ID NO: 6) within one 96-well assay plate. The concentrations of the PHI-4 polypeptides were within the 4 doses of the reference protein concentrations, preferably around the middle point of the 4 dose concentrations. Each sample plate contained the reference MBP::PHI-4 protein (SEQ ID NO: 6) in a significant number of wells such as 16 wells in 4 separate doses. In each plate, up to 80 MBP::PHI-4 polypeptide variants were included and assayed for activity comparison with the reference PHI-4 polypeptide protein. From a sample plate, 10 ul of samples from each well were picked by multi-channel pipette and dispensed in one assay plate containing 50 ul molten diet in each well and mixed on a shaker. This process of producing the assay plate was repeated as many as 6 times or more to produce a desired number of replicate assay plates. After the diet was solidified and cooled to 4° C., neonate WCRW larvae were placed in each well, the plate was sealed with perforated Mylar film and incubated in a constant temperature incubator at 25° C. After 4 days, the insect responses were scored under a magnifying glass. The sigmoid dose-response values (Responses) were converted to linear probit dose-response values using SAS-JMP®, Generalized Linear Model, Binomial Response, Probit). The response for each protein in replicates was summed, this sum was compared with the probit dose-response line of the activity reference protein and the nominal fold improvement in potency was calculated. This nominal fold improvement estimated for a given dose in a given experiment is defined as the Fast Activity Evaluation Guide Number (FAEGN). For example, if a PHI-4 polypeptide showed a certain % response value at 40 ppm and comparison to the Probit curve indicated that the same response is predicted for the reference protein at 100 ppm, then the FAE Guide Number is 2.5 (100/40). According to this analysis, the PHI-4 polypeptide is nominally 2.5 times more potent than the reference PHI-4 polypeptide protein. The FAE assay was typically done with 2 different doses of PHI-4 polypeptides at a time and performed in three independent experiments, generating 6 FAEGN for each mutant in a typical FAE evaluation. The mean FAEGN is calculated to yield the Mean FAE Index (MFI). As used herein "Mean FAE Index" (MFI) refers to the mean of multiple FAEGN (typically 6 or more); unless otherwise indicated MFI is understood to be an arithmetic mean of FAEGN. For each protein, a two sided t-test was done comparing the multiple FAEGN from the clone with FAEGN values from the reference protein (typically 48-96 FAEGN of SEQ ID NO: 6). The two-sided t-test was done between these 48-96 FAEGN associated with the reference protein and the 6 or more FAEGN associated with the variant of interest. The Bonferroni correction was used to evaluate p-values (number of novel proteins/alpha) for the hypothesis that a given variant is significantly different in insecticidal activity compared to the reference protein, MBP::PHI-4 fusion protein (SEQ ID NO: 6) unless otherwise noted. The Bonferroni correction was used to evaluate p-values (number of novel proteins/alpha) for the hypothesis that a given variant is significantly different in insecticidal activity compared to the reference protein, MBP::PHI-4 fusion protein (SEQ ID NO: 6) unless otherwise noted.

Effective Concentration$_{50}$ (EC50) evaluation: Variants of particular interest were assayed at higher power in more extensive dose response curves to more accurately estimate the EC50s. The preparation of dose response, infestation, incubation and scoring were as described for the FAE assay format. EC50 determinations were typically carried out with a no insecticidal protein control plus seven two-fold dilutions bracketing the expected EC50 (typically 100 ppm for MBP::PHI-4; SEQ ID NO: 6) and 24 or more replicate wells within a given experiment. As used herein, the EC50 is defined as the predicted point with 50% response in the scoring scheme. It is a combination of growth or feeding Inhibition and lethal responses. In order to determine EC50 values, each treatment (one dose) was repeated 6 or more, usually 24, times.

Figure 2:
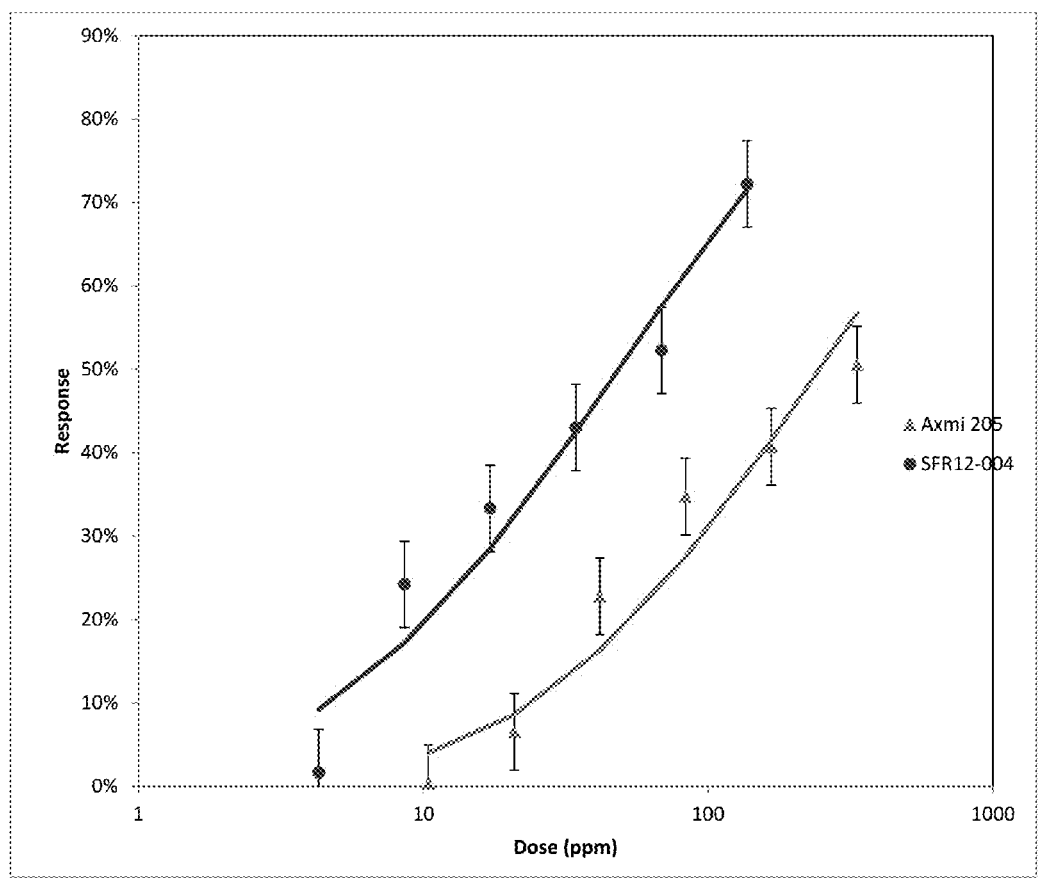

Data from exemplary FAE and EC50 determinations are given in FIGS. 1 and 2 respectively. MBP::PHI-4-SFR12-004 (SEQ ID NO: 31; Example 8) is a variant with improved insecticidal activity. FIG. 1 shows the primary data for a typical FAE assay. Proteins were purified and quantified as described above. The % response in a typical FAE assay is given on the y axis. The protein concentration (toxin portion of the protein only) is given on the x axis. The geometric mean FAE Index in this instance is 4.0. FIG. 2 shows the data for a typical EC50 measurement. Proteins were purified and quantified as described above. The fractional response (multiply by 100 to get "% Response") is given on the y axis. The inferred EC5Os are 245 ppm (MBP::PHI-1 of SEQ ID NO: 6) and 48 ppm (SFR12-004; SEQ ID NO: 31). The data indicate that the insecticidal activity of MBP::PHI-4-SFR12-004 (SEQ ID NO: 31) is increased relative to that of MBP::PHI-4 (SEQ ID NO: 6).

The MBP::PHI-4 fusion is rapidly cleaved in the presence of insect gut fluid to yield MBP and mature PHI-4 protein and it is believed that the insecticidal activity is due to the cleaved toxin molecules. The MBP::PHI-4 fusion protein (SEQ ID NO: 6) was digested with 1/100 (w/w) Factor Xa (New England Biolabs) at 25° C. overnight and the PHI-4 polypeptide was purified by Superdex 200 column chromatography utilizing the size difference and a weak affinity of MBP to Superdex. The MPB::PHI-4 fusion was also cleaved with trypsin and the mature PHI-4 polypeptide (derived from SEQ ID NO: 6) was purified. The mature, purified PHI-4 polypeptide derived from Factor Xa or trypsin cleavage has a MW of ~60 kDa as measured on SDS-PAGE gels and is fully reactive to polyclonal antisera that also react with the MBP::PHI-4 fusion protein. The EC50 of this "mature" PHI-4 polypeptide fragment is within experimental error of the EC50 of the MBP::PHI-4 parental protein (SEQ ID NO: 6, as calculated on the basis of ppm associated with the toxin fragment and excluding ppm associated with the MBP domain of SEQ ID NO: 6.

Example 4: Single Amino Acid PHI-4 Polypeptide Variants (S1-S4)

A set of 209 PHI-4 polypeptide single amino acid substitution variants spread across both the N and C terminal portions of the protein were made and characterized (Table 8; MUT ID: 1-209). The mutagenesis template was the polynucleotide of SEQ ID NO: 5 encoding PHI-4 (SEQ ID NO: 6) as an MBP fusion. The mutations were made using the QuickChange kit (Agilent; Catalogue #200524) essentially as described in Example 1. The particular amino acid substitutions relative to PHI-4 (SEQ ID NO: 2) are as indicated in Table 8. For example in Table 8, the PHI-4 polypeptide identified as MUT ID: 1 has a valine substituted for the native amino acid alanine at position 202 of PHI-4 (SEQ ID NO: 2) and referred to "A202V". The polypeptide variant for which activity is reported was prepared as an MBP fusion that is identical to SEQ ID NO: 6 except for this single amino acid substitution. In a similar manner, MUT ID: 1-872 (Table 8) are all made in the context of SEQ ID NO: 6; MUT ID: 873-910 (Table 8) are made in the context of SEQ ID NO: 8; MUT ID: 911-1135 (Table 8) are made in the context of SEQ ID NO: 10. All polypeptides of Table 8 were expressed and purified as MBP fusions as described in Example 2. The PHI-4 polypeptides were expressed as MBP fusions and purified as described in Example 2. The assay protocol for WCRW insecticidal activity of the PHI-4 polypeptides was essentially as described for FAE assays in Example 3 using SEQ ID NO: 6 as the reference protein. For the analysis of the data a "Mean Deviation Score" was calculated rather than a mean FAE Index. This is a related metric that is calculated as follows. Data from four two-fold dilutions of MBP::PHI-4 (typically about 25, 50, 100 and 200 ppm final concentration of PHI-4 fragment in artificial insect diet) is plotted on a Probit plot. The difference between response expected for MBP::PHI-4 (SEQ ID NO: 6) at a given dose, based on the Probit curve, and that observed for the mean score for a PHI-4 polypeptide variant at that given dose is calculated and this difference is defined as the Deviation Score. A negative Deviation Score indicates that the response is lower than that which is expected for the relevant parental backbone (typically MBP::PHI-4; SEQ ID NO: 6) at the same concentration and indicates that the variant is nominally less active than the parental backbone.

A positive Deviation Score indicates that the variant is nominally more potent than the parental backbone. As used herein, the Mean Deviation Score refers to the arithmetic mean of multiple Deviation Scores which are typically derived from independent experiments. The Mean Deviation Score is used to estimate rank order of activities associated with a set of variants within a given experiment. The Mean Deviation Scores for the 209 variants of this example are given in Table 8 and is typically an average of at least three independent Deviation Score measurements.

Example 5: Single Amino Acid Substitution Mutants #2 (SFR)

A BLAST search revealed that AXMI-205 is a bacterial perforin-like protein. Perforin proteins from *Clavibactor michiganensis* (GenBank Accession number: YP_001223127; SEQ ID NO: 49), *Laccaria bicolor* (GenBank Accession number: XP_001885969; SEQ ID NO: 48), *Marinomonas* sp. (GenBank Accession number: ZP_01077945; SEQ ID NO: 38), *Nematostella vectensis* (GenBank Accession number: XP_001617993; SEQ ID NO: 50), *Photorhabdus luminescens* (GenBank Accession number: NP_928713; SEQ ID NO: 1507), and *Serratia proteamaculans* (GenBank Accession number: YP_00147861; SEQ ID NO: 1506) were found to be homologous to AXMI-205. The N-terminal region of up to 311 amino acid of AXMI-205 (SEQ ID NO: 35) is highly homologous to those perforin proteins. Among those perforin proteins, the 3D X-ray structure of *Photorhabdus* perforin-like protein has been published (Science 317, 1548-1551, 2007; PDB ID: 2QP2; SEQ ID NO: 1508). According to the leading theory of perforin mode of action, the protein inserts 5 alpha helices of its N-terminal region into the target host membrane to form a large size pore (*Proc. Natl. Acad. Sci. USA* 102, 600-605, 2005; *Immunology Today,* 16, 194-201, 1995). In the *Photorhabdus* 2QP2 structure, there are two loops between Alpha C and D and Alpha I and J are considered to be the site for initiating the membrane insertion of those 5 alpha helices. These loops are called membrane insertion initiation loops. The primary sequences of those perforin proteins listed below were aligned using Vector NTI Align X function in order to identify the membrane insertion loop sequences of AXMI-205 (SEQ ID NO: 35). Amino acid sequences of V92-A103 and G211-E220 of SEQ ID NO: 6 were aligned with the membrane insertion initiation loops identified in the 2QP2 structure. A number of acidic, basic and other hydrophilic amino acids were found in the AXMI-205 (SEQ ID NO: 35) membrane insertion loops indicating these loops are exposed to the solvent.

Based on this homology model and prior mutation-activity relationship data, another 664 single amino acid substitution PHI-4 polypeptide variants were made in order to assess the sequence-insecticidal activity-relationships at the selected positions. This set of 664 point mutations (Table 8; MUT ID: 210-872) were made with MBP::PHI-1 polypeptide of SEQ ID NO: 5 as the DNA template. Mutations were made according to the method of Example 1. The mutagenesis oligonucleotides used to create an exemplary mutant (PHI-4-R97D; SEQ ID NO: 7) are SEQ ID NO: 13 and SEQ ID NO: 14. The other PHI-4 polypeptides (Table 8; MUT ID: 210-872) were made in the same manner using mutagenesis oligonucleotides designed to create the selected substitutions at the desired residues of the protein. The resulting PHI-4 polypeptides were purified as MBP fusions and the activity measured in the FAE assay format or EC50 assay format as described in Examples 2 & 3. The Mean FAE Indices associated with these 664 PHI-4 polypeptides are given in lines 210-872 of Table 8.

Example 6: SFR16 Point Mutants

Another set of 38 single amino acid substitution PHI-4 polypeptide variants (Table 8; MUT ID: 873-910) were made with MBP::PHI-4-R97D (SEQ ID NO: 7; Example 5) as the backbone. The substitutions were selected based on the sequence-activity relationships inferred from the PHI-4 polypeptide variants of the preceding Examples. Mutations were made according to the method of Example 1. Variants were purified as MBP fusions and activity measured in FAE assay format as described in Examples 2 & 3. The Mean FAE Indices associated with these mutants are given in lines 873-910 of Table 8. The reference for the Mean FAE Index in this example is SEQ ID NO: 8.

Example 7: PSR3 Mutants

The C-terminal domain of AXMI-205 shares significant homology with proteins that have β-prism 3D structural folding patterns. In the typical β-prism, the oligosaccharide binding site is almost always in a cavity formed between the apex and belt-loops from the same Greek-key motif. The primary amino-acid sequence motif has been identified as G-$X_3$-D (SEQ ID NO: 39) in banana lectin, which has two binding sites (Meagher J L et al *Glycobiology* 15:1033-42; 2005). The primary sequence of the PHI-4 polypeptide of SEQ ID NO: 2 contains 3 such motifs. The canonical structure of these motifs is indicated in FIG. 3. In addition, the G-$X_3$-D motif (SEQ ID NO: 39) can be extended toward the N-terminal direction into the D-X-G-[S/T]-G-$X_3$-D motif (SEQ ID NO: 40), which are present 1, 2 or 3 times in 24 proteins that are orthologous to the C-terminal portion of AXMI-205 (GenBank accession numbers: gi|136474758; gi|136444345; gi|136141087; gi|143658948; gi|142085802; gi|135275135; gi|138446054; gi|294814724; gi|170109524; gi|156316804; gi|156377786; gi|170109526; gi|77456557; gi|1209377; gi|302823768; gi|302532087; gi|256764986; gi|302787479; gi|302823738; gi|169762636; gi|302766657; gi|270056485; gi|302792467; gi|238488445;). Each of the 3 loops in the PHI-4 polypeptide of SEQ ID NO: 2 has potential to bind an oligosaccharide, a putative binding receptor present in WCRW mid-gut cell membrane surface.

As indicated in Table 8, 225 PHI-4 polypeptide variants (MUT IDs: 911-1135) were made to introduce an additional amino acid substitution into the PHI-4 polypeptide of PHI-4-D09 (SEQ ID NO: 10) using MBP::PHI-4-D09 (SEQ ID NO: 9) as the DNA template. The PHI-4-D09 backbone contains the following substitutions relative to SEQ ID NO: 2: L40I, Y98F, L145V, L163V, I172L, V355I, and P412A (numbers are relative to the PHI-4 polypeptide backbone of SEQ ID NO: 2. Mutagenesis was done by a modification of the method of Dominy et al (Methods in Molecular Biology, Vol. 235:209-223; 2003). Briefly, "NNK" mutagenesis at position 396 was done as follows. A pMAL vector encoding SEQ ID NO: 9 was amplified by inverse PCR for 20 cycles using SEQ ID NO: 15 & SEQ ID NO: 16. The PCR product was diluted 10-fold, subjected to one additional round of amplification using SEQ ID NO: 16 & SEQ ID NO: 17. The PCR product was purified on QuiaQuick™ column, phosphorylated with T4 polynucleotide kinase, circularized with T4 DNA ligase and transformed into *E. coli* BL21(DE3) cells. Candidate colonies were amplified by colony PCR and the PCR product was sequenced first with a single primer to confirm the presence of the desired mutation and subsequently sequenced fully with multiple primers to identify clones with no additional mutations. All other PHI-4 polypeptides of this example (Table 8, lines 911-1135) were made by a similar manner using mutagenesis oligonucleotides designed to create the selected substitutions at the desired residues of the protein. Positions with multiple desired mutations were made with degenerate forward primers whereas positions with only one desired mutation were made with non-degenerate primers. Clones with the desired sequences were used to express protein essentially as described in Example 2. Protein purification, activity measurements and statistical analysis was done essentially as described in example 3. The Mean FAE Index reflects the fold difference relative to PHI-4 polypeptide of SEQ ID NO: 6. The Mean EC50 of PHI-4-D09 (SEQ ID NO: 10) was measured at high statistical power and is 1.3-fold improved relative to MBP::PHI-4 (SEQ ID NO: 6). PHI-4 polypeptides of this example with Mean FAE Index>1.3× are deemed nominally improved relative to the parental backbone (MBP::PHI-4-D09; SEQ ID NO: 10) and diversity meeting this criterion was used for production of subsequent combinatorial mutants.

Example 8: Identification of Combinatorial Mutants of PHI-4 Polypeptides with Improved Insecticidal Activity as Measured in an Artificial Insect Diet Feeding Assay Activity diversity identified in Examples 4-7 was used to create 192 combinatorial PHI-4 polypeptide variants (SEQ ID NO: 51-242; Table 9). The PHI-4 polypeptide variants were made by sequential point mutagenesis by the method of Example 1. In all cases, the indicated PHI-4 polypeptide variants were made as MBP fusions with the same linker as is indicated in SEQ ID NO: 6. The MBP::PHI-4 polypeptides were expressed and purified as indicated in Example 2 & 3. Purified MBP::PHI-4 polypeptides were assayed in FAE assays to derive a Mean FAE Index or in EC50 assays as indicated in Example 3. Thirty-seven exemplary active PHI-4 polypeptide variants with increased Mean FAE Indices are given in Table 3, along with the sequence variation relative to SEQ ID NO: 6. The substitutions relative to PHI-4 polypeptide of SEQ ID NO: 2 are given in the right-most column. All proteins were expressed and purified as MBP fusions. The reference protein for the Mean FAE Index is MPB::PHI-4 (SEQ ID NO: 6). The functional data on all of the PHI-4 polypeptides of this example is given in lines 51-242 of Table 9.

TABLE 3

| Ex. # | SEQ ID NO: | Alias | FAE | p value | Mutation List (vs. SEQ ID NO: 2) |
|---|---|---|---|---|---|
| 8 | 148 | SFR11-001 | 27.4 | 1.36E−13 | R097D, K099L, E220D, K289L, R293Q |
| 8 | 225 | SFR17-013 | 20.9 | 0.001577 | D042N, E046N, R097D, K099L, E220D, K289L, R293Q, S333K, G336A, S401H, K402H |
| 8 | 226 | SFR17-019 | 20.1 | 1.25E−07 | D042N, E046N, R097D, K099L, E220D, K289L, R293Q, S333K, G336A, V355I, S401H, K402H, P412A |
| 8 | 227 | SFR17-014 | 19.5 | 1.48E−09 | D042N, E046N, R097D, K099L, E220D, K289L, S333K, G336A, S401H, K402H, P412A |
| 8 | 228 | SFR17-011 | 19.0 | 5.42E−09 | D042N, E046N, R097D, K099L, E220D, K289L, S333K, G336A, S401H, K402H |
| 8 | 229 | SFR17-005 | 17.1 | 6.82E−10 | R097D, K099L, E220D, K289L, R293Q, S401H, K402H, P412A |
| 8 | 73 | SFR10-032 | 17.1 | 1.48E−19 | R097D, S333K, G336A |
| 8 | 230 | SFR17-018 | 16.5 | 7.08E−09 | R097D, K099L, E220D, K289L, R293Q, S333K, G336A, V355I, S401H, K402H, P412A |
| 8 | 149 | SFR11-012 | 14.8 | 8.29E−15 | R097D, K099L |
| 8 | 231 | SFR17-009 | 13.5 | 7.19E−16 | D042N, E046N, R097D, K099L, E220D, K289L, R293Q, V355I, S401H, K402H, P412A |
| 8 | 232 | SFR17-006 | 13.1 | 1.63E−10 | D042N, E046N, R097D, K099L, E220D, K289L, R293Q, S401H, K402H, P412A |
| 8 | 233 | SFR17-016 | 12.9 | 5.18E−12 | D042N, E046N, R097D, K099L, E220D, K289L, R293Q, S333K, G336A, S401H, K402H, P412A |
| 8 | 150 | SFR11-005 | 12.8 | 2.12E−10 | R097D, K099L, E220D, K289L |
| 8 | 74 | SFR10-042 | 12.0 | 7.73E−11 | R097D, S401H |
| 8 | 234 | SFR17-012 | 11.7 | 1.82E−07 | R097D, K099L, E220D, K289L, R293Q, S333K, G336A, S401H, K402H |
| 8 | 235 | SFR17-004 | 11.3 | 7.41E−06 | D042N, E046N, R097D, K099L, E220D, K289L, S401H, K402H, P412A |
| 8 | 236 | SFR17-017 | 10.5 | 2.1E−15 | D042N, E046N, R097D, K099L, E220D, K289L, S333K, G336A, V355I, S401H, K402H, P412A |
| 8 | 151 | SFR11-014 | 9.9 | 2.08E−09 | R097D, K289L |
| 8 | 237 | SFR17-003 | 9.7 | 1E−04 | D042N, E046N, R097D, K099L, E220D, K289L, R293Q, S401H, K402H |
| 8 | 183 | SFR13-035 | 9.3 | 1.5E−11 | R097D, K099L, E220D, K289L, V355I, A396T, P412A, K520E |
| 8 | 75 | SFR10-72 | 8.9 | 0.003487 | R097D, S333V, K520E, Q527K |
| 8 | 238 | SFR17-001 | 8.7 | 0.010038 | D042N, E046N, R097D, K099L, E220D, K289L, S401H, K402H |
| 8 | 76 | SFR10-056 | 8.4 | 2.98E−05 | R097D, G462A, R464A, K465M |
| 8 | 77 | SFR10-036 | 8.2 | 1.37E−05 | R097D, S333K, G336A, E339N |
| 8 | 239 | SFR17-015 | 8.2 | 4.75E−21 | R097D, K099L, E220D, K289L, R293Q, S333K, G336A, S401H, K402H, P412A |
| 8 | 152 | SFR11-015 | 8.2 | 1.76E−07 | R097D, R293Q |
| 8 | 153 | SFR11-010 | 8.1 | 1.7E−06 | R097D, E220D, K289L |
| 8 | 240 | SFR17-002 | 7.6 | 5.14E−09 | R097D, K099L, E220D, K289L, R293Q, S401H, K402H |
| 8 | 78 | SFR10-039 | 7.2 | 9.2E−12 | R097D, S333V, G336A, S338V |
| 8 | 79 | SFR10-82 | 6.7 | 8.17E−06 | R097D, S401H, K402H, K520E, Q527K |
| 8 | 80 | SFR10-045 | 6.6 | 2.09E−14 | R097D, S401H, K402H |

TABLE 3-continued

| Ex. # | SEQ ID NO: | Alias | FAE | p value | Mutation List (vs. SEQ ID NO: 2) |
|---|---|---|---|---|---|
| 8 | 81 | SFR10-087 | 6.4 | 2.15E−06 | R097D, S401G, K402H, K520E, Q527K |
| 8 | 82 | SFR10-060 | 6.3 | 2.89E−08 | R097D, G462A, R464K, K465M |
| 8 | 51 | SFR5-014 | 6.2 | 1.65E−05 | R097D, R293Q, R416E, K520E |
| 8 | 184 | SFR13-018 | 6.1 | 1.84E−13 | R097D, K099L, E220D, K289L, V355I, S401G, P412A, K520E |
| 8 | 154 | SFR11-013 | 5.5 | 1.54E−09 | R097D, E220D |
| 8 | 241 | SFR17-007 | 5.5 | 5.11E−22 | D042N, E046N, R097D, K099L, E220D, K289L, V355I, S401H, K402H, P412A |

Example 9: Identification of Combinatorial Mutants of PHI-4 Polypeptides with Improved Insecticidal Activity as Measured in an Artificial WCRW Insect Diet Feeding Assay Activity data from 315 PHI-4 polypeptide combinatorial variants (SEQ ID NOs: 243-558) is provided in Table 9. Libraries were initially prepared by incorporation of diversity into SEQ ID NO: 5. The diversity was largely derived from that described in Example 4. Oligonucleotides encoding diversity at forty positions were incorporated into SEQ ID NO: 5 in a DNA shuffling reaction essentially as described (Ness et al., *Nature Biotechnol.* 20, 1251; 2002). Briefly, oligonucleotides typically of 30-45 bases in length encoding the diversity elements of interest were mixed at 0.02-2 micromolar each in the presence of an appropriate concentration of fragments of SEQ ID NO: 5. This reaction was assembled, rescued and cloned essentially as described for synthetic genes in Example 10 and as described (Ness et al., *Nature Biotechnol.* 20, 1251; 2002). Improved variants from initial libraries were subjected to family DNA shuffling essentially as described (A. Crameri, et al *Nature* 391, 288; 1998). This family shuffled library was screened by methods similar to those described in Example 3 (FAE) and to those described in Example 4 (Mean Deviation Score). Selected, improved PHI-4 polypeptide variants from the second round of DNA shuffling were further diversified by recombining N terminal and C terminal domains of elite clones using the method of splicing by overlap extension (R. Horton, et al., *Gene* 77:61-68; 1989) to yield novel variants. All variants were purified by the method of Example 2 and assayed by the method of Mean Deviations of Example 4. PHI-4 polypeptides variants identified are given in Table 9 (SEQ ID NO: 243-558).

Example 10: Identification of Combinatorial Mutants of PHI-4 Polypeptides with Improved Insecticidal Activity as Measured in an Artificial WCRW Insect Diet Feeding Assay A set of 158 PHI-4 polypeptide combinatorial variants (SEQ ID NO: 559-716) were prepared by total gene synthesis, essentially as described by Stemmer et al (Gene 164:49-53; 1995). An additional treatment was implemented as described (Saaem, I. et al, *Nucleic Acids Research*, Published Nov. 29, 2011, 1-8). Briefly, in a typical gene synthesis reaction a set of oligonucleotides of 120 bases each encoding both top and bottom strands of the target gene were designed. Complementary oligos typically overlap by 54-65 nucleotides. Oligos to make synthetic genes are combined such that a final concentration of each oligo is approximately 0.05-1 uM. Gene assembly is typically done with Herculase II (Agilent) using the following cycling program: 98° C. 3 min followed by (96° C.×30 sec, 40° C.×30 sec, 72° C.×30 sec)×24 cycles. The initial PCR is then used as template for a second PCR in which a second pair of primers is used to amplify the fully synthetic gene product. Typical PCR conditions for the second synthetic gene reaction were 98° C. 3 min followed by (96° C. 30 sec, 50° C. 30 sec, 72° C. 35 sec), ×24 cycles. Reactions were analyzed by 1% E-gels (Invitrogen). A subsequent treatment consisting of a re-annealing step, treatment with Cell (Transgenomics; Catalogue #706020) and subsequent amplification (25 cycles) was done essentially as described (Saaem, I. et al, *Nucleic Acids Research*, Published Nov. 29, 2011, 1-8). A third and final amplification of the synthetic gene was done with similar PCR conditions in a single cycle. The product of this reaction was purified and ligated by Gibson ligation method (New England Biolabs; Catalogue ## E2611L) to an appropriate vector transformed to chemical competent BL21(DE3) cells. Sequence verified clones (Lines 559-716 of Table 9) comprising the PHI-4 polypeptide were expressed as MBP fusions, purified and assayed essentially as described in Examples 2 and 3. Table 4 shows the SEQ ID NOs: and substitutions relative to the PHI-4 polypeptide of SEQ ID NO: 2 for twenty active variants. The mean FAE Index is calculated relative to the MBP::PHI-4 backbone (SEQ ID NO: 6).

TABLE 4

| Ex. # | SEQ ID NO: | Alias | FAE | p value | Mutation List (vs. SEQ ID NO: 2) |
|---|---|---|---|---|---|
| 10 | 559 | PSR1-1-076 | 25.6 | 3.26E−05 | D042N, Y098F, L145V, L153I, I172L, Y206F, I283V, V355I, G359A, W389L, I410V, A417S |
| 10 | 560 | PSR1-1-074 | 22.7 | 4.19E−05 | D042N, Y098F, I283V, V355I |
| 10 | 561 | PSR1-2-145 | 15.9 | 7.67E−06 | E046N, Y098F, L145V, Y171F, I172L, D182Q, E278N, V355I, I410V, A417S, Q442E, V455I |
| 10 | 562 | PSR1-2-082 | 11.6 | 1.46E−18 | F043E, Y098F, L145V, Y171F, I172L, Y206F, E278N, E339Q, V355I, V455I, W457N |
| 10 | 563 | PSR1-2-088 | 11.0 | 3.91E−05 | F043E, Y098F, L145V, Y171F, I172L, Y206F, E278N, V355I, Q442E, V455I, W457N |
| 10 | 564 | PSR1-2-094 | 10.1 | 1.07E−10 | D042N, F043E, Y098F, L145V, Y171F, I172L, E278N, M354L, V355I, V455I, W457N |
| 10 | 565 | PSR1-2-110 | 9.7 | 2.8E−08 | D042N, F043E, Y098F, L145V, Y171F, I172L, E278N, V355I, I410V, Q442E, V455I |
| 10 | 566 | PSR1-1-073 | 8.5 | 0.003166 | D042N, Y098F, I283V, V355I, A417S |
| 10 | 567 | PSR1-2-091 | 7.2 | 1.03E−10 | D042N, F043E, Y098F, L145V, Y171F, I172L, V355I, Q442E, V455I, W457N |
| 10 | 568 | PSR1-2-149 | 7.0 | 8.39E−08 | F043E, Y098F, L145V, Y171F, I172L, Y206F, E278N, V355I, A417S, V455I, W457N |
| 10 | 569 | PSR1-2-087 | 6.9 | 3.93E−10 | D042N, F043E, Y098F, L145V, Y171F, I172L, E278N, V355I, Q442E, V455I, W457N |
| 10 | 570 | PSR1-2-158 | 6.9 | 1.01E−07 | D042N, R097N, Y098F, L145V, Y171F, I172L, V355I, I410V, V455I |

TABLE 4-continued

| Ex. # | SEQ ID NO: | Alias | FAE | p value | Mutation List (vs. SEQ ID NO: 2) |
|---|---|---|---|---|---|
| 10 | 571 | PSR1-2-086 | 6.7 | 2.02E−05 | E046N, Y098F, L145V, Y171F, I172L, D182Q, E278N, V355I, Q442E, V455I, W457N |
| 10 | 572 | PSR1-1-053 | 6.5 | 0.010726 | D042N, I052V, Y098F, L145V, I172L, Y206F, I283V, V355I, H370R, I410V, P412A, A417S, T426S, T461S |
| 10 | 573 | PSR1-2-096 | 6.2 | 5.28E−07 | D042N, F043E, Y098F, L145V, Y171F, I172L, V210I, I283V, M354L, V355I, V455I, W457N |
| 10 | 574 | PSR1-2-135 | 6.1 | 2.92E−11 | D042N, R097N, Y098F, L145V, Y171F, I172L, V355I, H370R, Q442E, V455I |
| 10 | 575 | PSR1-1-014 | 5.9 | 0.018276 | D042N, R097N, Y098F, L145V, I172L, I283V, V355I, I410V, Q442E, V455I |
| 10 | 576 | PSR1-2-141 | 5.8 | 5.02E−09 | E046N, R097N, Y098F, L145V, Y171F, I172L, V355I, Q442E, V455I |
| 10 | 577 | PSR1-1-006 | 5.6 | 0.017252 | E046N, Y098F, L145V, L163V, I172L, Y206F, V210I, E339Q, V355I, A417S |
| 10 | 578 | PSR1-2-095 | 5.3 | 7.35E−05 | F043E, Y098F, L145V, Y171F, I172L, Y206F, E278N, M354L, V355I, V455I, W457N |

Example 11: Identification of Combinatorial Mutants of PHI-4 Polypeptides with Improved Insecticidal Activity as Measured in an Artificial Insect Diet Feeding Assay Sixty-six PHI-4 polypeptide variants (SEQ ID NO: 717-783), containing permutations of a number of substitutions, were made by total gene synthesis, essentially as described in Example 10. The substitutions were done in the context of a backbone (PSR1-2-105; SEQ ID NO: 584 from Table 9) containing the following substitutions relative to PHI-4 polypeptide of SEQ ID NO: 2: E46N, R97N, Y98F, L145V, Y171F, I172L, V355I, I410V, V455I, and W457N. The resulting MBP::PHI-4 polypeptide fusion proteins were expressed, purified, assayed for insecticidal activity on WCRW larvae and analyzed for insecticidal relative to MBP::PHI-4 (SEQ ID NO: 6) using the Mean FAE Index metric as described in Examples 2 & 3. Table 5 shows the Mean FAE Indices, SEQ ID NOs: and substitutions relative to PHI-4 polypeptide of SEQ ID NO: 2 for twenty active PHI-4 polypeptide variants of this example. The Mean FAE Index was calculated relative to the MBP::PHI-4 backbone (SEQ ID NO: 6). The insecticidal activities of the PHI-4 polypeptides in Table 5 (Mean FAE Index) reflect the arithmetic means of three independent experiments and are expressed as fold WCRW insecticidal activity improvement of the PHI-4 polypeptide variants relative to MBP::PHI-4 (SEQ ID NO: 6). As indicated, the mean FAE Indices range from 0.26× to >8× (fold improvement relative to MBP::PHI-4). The majority of the PHI-4 polypeptides have increased insecticidal activity relative to MBP::PHI-4 (FAE>1). The p values indicate that the measured differences relative to MBP::PHI-4 (SEQ ID NO: 6) are highly significant.

TABLE 5

| Ex. # | SEQ ID NO: | Alias | FAE | Mutation List (vs. SEQ ID NO: 2) |
|---|---|---|---|---|
| 11 | 717 | PSR7-141 | 10.0 | E046N, R097N, Y098F, L145V, Y171F, I172L, V355I, A396K, S401K, D403Y, I410V, V455I, W457N |
| 11 | 718 | PSR7-63 | 8.4 | E046N, R097N, Y098F, L145V, Y171F, I172L, V355I, A396L, S401H, K402G, I410V, V455I, W457N |
| 11 | 719 | PSR7-89 | 8.1 | E046N, R097N, Y098F, L145V, Y171F, I172L, V355I, A396L, S401H, D403Y, I410V, V455I, W457N |
| 11 | 720 | PSR7-94 | 6.6 | E046N, R097N, Y098F, L145V, Y171F, I172L, V355I, A396G, S401K, I410V, V455I, W457N |
| 11 | 721 | PSR7-106 | 6.1 | E046N, R097N, Y098F, L145V, Y171F, I172L, V355I, A396K, D403Y, I410V, V455I, W457N |
| 11 | 722 | PSR7-96 | 6.1 | E046N, R097N, Y098F, L145V, Y171F, I172L, V355I, A396L, S401H, K402W, D403Y, I410V, V455I, W457N |
| 11 | 723 | PSR7-100 | 5.0 | E046N, R097N, Y098F, L145V, Y171F, I172L, V355I, A396K, K402H, I410V, V455I, W457N |
| 11 | 724 | PSR7-148 | 4.7 | E046N, R097N, Y098F, L145V, Y171F, I172L, V355I, A396G, S401K, K402G, D403Y, I410V, V455I, W457N |
| 11 | 725 | PSR7-98 | 4.7 | E046N, R097N, Y098F, L145V, Y171F, I172L, V355I, A396K, S401H, K402W, D403Y, I410V, V455I, W457N |
| 11 | 726 | PSR7-113 | 4.5 | E046N, R097N, Y098F, L145V, Y171F, I172L, V355I, A396K, S401K, I410V, V455I, W457N |
| 11 | 727 | PSR7-121 | 4.5 | E046N, R097N, Y098F, L145V, Y171F, I172L, V355I, S401H, I410V, V455I, W457N |
| 11 | 728 | PSR7-7 | 4.5 | E046N, R097N, Y098F, L145V, Y171F, I172L, V355I, A396K, S401H, K402H, I410V, V455I, W457N |
| 11 | 729 | PSR7-86 | 4.2 | E046N, R097N, Y098F, L145V, Y171F, I172L, V355I, A396K, S401G, K402H, I410V, V455I, W457N |
| 11 | 730 | PSR7-155 | 3.7 | E046N, R097N, Y098F, L145V, Y171F, I172L, V355I, S401H, K402G, D403Y, I410V, V455I, W457N |
| 11 | 731 | PSR7-116 | 3.6 | E046N, R097N, Y098F, L145V, Y171F, I172L, V355I, S401K, K402W, D403Y, I410V, V455I, W457N |
| 11 | 732 | PSR7-95 | 3.4 | E046N, R097N, Y098F, L145V, Y171F, I172L, V355I, S401I, K402H, D403Y, I410V, V455I, W457N |
| 11 | 733 | PSR7-90 | 3.3 | E046N, R097N, Y098F, L145V, Y171F, I172L, V355I, A396L, K402G, I410V, V455I, W457N |
| 11 | 734 | PSR7-97 | 3.3 | E046N, R097N, Y098F, L145V, Y171F, I172L, V355I, A396G, K402H, I410V, V455I, W457N |
| 11 | 735 | PSR7-64 | 2.8 | E046N, R097N, Y098F, L145V, Y171F, I172L, V355I, A396G, S401K, K402W, D403Y, I410V, V455I, W457N |
| 11 | 736 | PSR7-93 | 2.8 | E046N, R097N, Y098F, L145V, Y171F, I172L, V355I, S401H, K402W, D403Y, I410V, V455I, W457N |

Example 12: Identification of Combinatorial Mutants of PHI-4 Polypeptides with Improved Insecticidal Activity as Measured in an Artificial WCRW Insect Diet Feeding Assay Thirty six PHI-4 polypeptide variants (Table 9; SEQ ID NO: 784-819), containing permutations of eleven substitutions (E220D, G336A, K099L, K289L, K402H, K520E, P412A, R097D, S333K, S401H, V355I; numbering scheme as per SEQ ID NO: 2; all variants made as MBP fusions as indicated in Table 9), were made using site directed mutagenesis as described in Example 1 and PHI-4 polypeptide variants were expressed, purified, assayed for insecticidal activity on WCRW larvae and analyzed for insecticidal activity relative to PHI-4 polypeptide of SEQ ID NO: 2 as described in Examples 2 & 3. Table 6 shows the Mean FAE Indices, SEQ ID NOs: and substitutions relative to the PHI-4 polypeptide of SEQ ID NO: 2 for twenty active PHI-4 polypeptide variants of this example. The mean FAE Index is calculated relative to the MBP::PHI-4 backbone (SEQ ID NO: 6). The mean FAE indices reflect the arithmetic means of three independent experiments. As indicated, the mean FAE indices range from 4.5 to >8. The p values indicate that the measured differences relative to MBP::PHI-4 (SEQ ID NO: 6) are highly significant.

TABLE 6

| Ex. # | SEQ ID NO: | Alias | FAE | Mutation List (vs. SEQ ID NO: 2) |
|---|---|---|---|---|
| 12 | 784 | SFR15-009 | 18.8 | R097D, K099L, E220D, K289L, S333K, G336A, S401H, K402H, K520E |
| 12 | 785 | SFR15-019 | 8.0 | R097D, K099L, E220D, K289L, S401H, K402H, P412A |
| 12 | 786 | SFR15-021 | 7.9 | R097D, K099L, E220D, K289L, S333K, G336A, S401H, K402H |
| 12 | 787 | SFR15-033 | 7.9 | R097D, K099L, E220D, K289L, S333K, V355I, S401H, K402H |
| 12 | 788 | SFR15-020 | 7.3 | R097D, K099L, E220D, K289L, V355I, S401H, K402H, P412A |
| 12 | 789 | SFR15-027 | 7.0 | R097D, K099L, E220D, K289L, S333K, V355I, S401H |
| 12 | 790 | SFR15-036 | 6.6 | R097D, K099L, E220D, K289L, V355I, K520E |
| 12 | 791 | SFR15-007 | 6.6 | R097D, K099L, E220D, K289L, S401H, K402H, P412A, K520E |
| 12 | 792 | SFR15-017 | 5.5 | R097D, K099L, E220D, K289L, S401H, K402H |
| 12 | 793 | SFR15-015 | 5.5 | R097D, K099L, E220D, K289L, S333K, G336A, P412A |
| 12 | 794 | SFR15-005 | 5.4 | R097D, K099L, E220D, K289L, S401H, K402H, K520E |
| 12 | 795 | SFR15-001 | 5.3 | R097D, K099L, E220D, K289L, S333K, G336A, K520E |
| 12 | 796 | SFR15-030 | 5.2 | R097D, K099L, E220D, K289L, V355I |
| 12 | 797 | SFR15-025 | 5.1 | R097D, K099L, S333K, G336A, S401H, K402H, K520E |
| 12 | 798 | SFR15-011 | 5.0 | R097D, K099L, E220D, K289L, S333K, G336A, S401H, K402H, P412A, K520E |
| 12 | 799 | SFR15-012 | 4.9 | R097D, K099L, E220D, K289L, S333K, G336A, V355I, S401H, K402H, P412A, K520E |
| 12 | 800 | SFR15-029 | 4.7 | R097D, K099L, E220D, K289L, S333K, V355I, S401H, P412A |
| 12 | 801 | SFR15-016 | 4.7 | R097D, K099L, E220D, K289L, S333K, G336A, V355I, P412A |
| 12 | 802 | SFR15-010 | 4.5 | R097D, K099L, E220D, K289L, S333K, G336A, V355I, S401H, K402H, K520E |
| 12 | 803 | SFR15-003 | 4.5 | R097D, K099L, E220D, K289L, S333K, G336A, P412A, K520E |

Example 13: Accordance Between FAE and EC50 Assays

Figure 4:
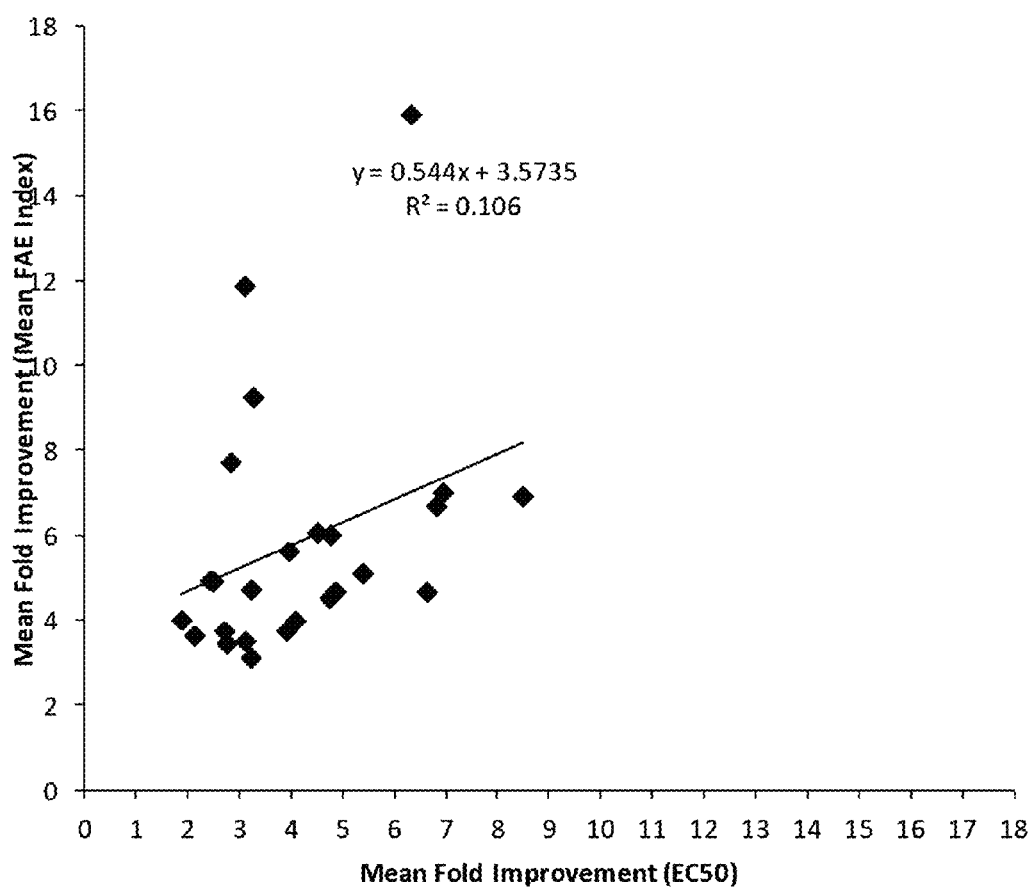

Experimental data on Mean FAE Index and mean EC50 for twenty-five PHI-4 polypeptide variants is given in FIG. 4. PHI-4 polypeptide variants were first tested in the FAE assay and then selected ones were retested in a multiple EC50 assays. In general, the fold improvement in mean FAE Index is modestly larger than the fold improvement that was subsequently measured in Mean EC50 measurements. This overall trend is as expected from the phenomenon of regression toward the mean (International Journal of Epidemiology 2005; 34:215-220). All 25 PHI-4 polypeptides elected for retesting in EC50 assays repeated as being significantly improved. FIG. 4 shows the EC50 measurements for representative variants from Table 9 (SEQ ID NO: 610, SEQ ID NO: 595, SEQ ID NO: 584, SEQ ID NO: 591, SEQ ID NO: 576, SEQ ID NO: 73, SEQ ID NO: 74, SEQ ID NO: 75, SEQ ID NO: 79, SEQ ID NO: 81, SEQ ID NO: 150, SEQ ID NO: 150, SEQ ID NO: 149, SEQ ID NO: 167, SEQ ID NO: 167, SEQ ID NO: 164, SEQ ID NO: 164, SEQ ID NO: 170, SEQ ID NO: 170, SEQ ID NO: 795, SEQ ID NO: 794, SEQ ID NO: 784, SEQ ID NO: 799, SEQ ID NO: 785, SEQ ID NO: 788, SEQ ID NO: 786, SEQ ID NO: 796, SEQ ID NO: 787).

Example 14: Combinatorial Substitutions

Example 11 yielded numerous PHI-4 polypeptide variants with improved insecticidal activity based on combinatorial substitutions of the three lectin-like motifs described in Example 7. A combinatorial library was prepared of 120 genes based on this diversity as follows. SEQ ID NOs: 760 & 761 each contains unique substitutions in loop 1. SEQ ID NOs: 717-726; 728-732; 734-737 & 760 contain unique substitutions in loop 2. SEQ ID NOs: 761 and 758 contain unique substitutions in loop 3. Gene synthesis was used to create a combinatorial library of these loop sequences essentially as described in Example 10. These genes can be expressed and assayed for activity on WCRW larvae by the methods described above.

Example 15: Mutagenesis of Putative Protease Sensitive Sites of PHI-4 Polypeptides Trypsin was used to identify the site(s) where proteases possibly attack (Protease Accessible Sites) the PHI-4 polypeptide of SEQ ID NO: 2. The PHI-4 polypeptide of SEQ ID NO: 2 in 50 mM Tris-HCl, pH8 was mixed with 1/50 (weight/weight) trypsin and incubated for 1 hr. at 37° C. It was found that protein was relatively resistant to trypsin, with no immediate digestion down to the small fragments, but produced a 55 kDa major band and 24 kDa minor band by SDS-PAGE analysis after the incubation. These two bands were excised from the gel and analyzed by mass spectrometry and N-terminal sequencing. The N-terminal sequencing revealed SAANAGQLGN (amino acids 3-12 of SEQ ID NO: 2) for the 55 kDa protein indicating that only two amino acid residues, Methionine and Alanine were missing from the N-terminal sequence. The mass-spectrometry, however, showed a loss of C-terminal sequence from Ser at 521 to Leu at 536 of SEQ ID NO: 2. This indicates that trypsin digested the PHI-4 polypeptide protein at the C-terminal side of Lys at 520 of SEQ ID NO: 2. The N-terminal sequence of the 24 kDa band was VDKVLLMD (amino acids 314 to 321 of SEQ ID NO: 2). The mass-spectrometry analysis on the 24 kDa fragment confirmed the C-terminal region of PHI-4 polypeptide of SEQ ID NO: 2 starting with Val at 314 relative to SEQ ID NO: 2 as shown by N-terminal sequencing and ending at Lys at 520 relative to SEQ ID NO: 2. This indicated that trypsin digested the PHI-4 polypeptide of SEQ ID NO: 2 at the C-terminal side of Lys at 313 of SEQ ID NO: 2.

From this experiment, it was found that there are at least two protease accessible sites, Lys at 313 and Lys at 520 SEQ ID NO: 6. These two sites were mutated to other amino acid residues by saturation mutagenesis and it was found that mutations at Lys at 313 and Lys at 520 of SEQ ID NO: 2 increase the insecticidal activity significantly. For example, the activity of the PHI-4 polypeptide variant, K313Q (MUT ID: 889), was enhanced 2.3 fold over the activity of PHI-4 polypeptide of SEQ ID NO: 2 as measured in an FAE assay (Table 8). The activity of the PHI-4 polypeptide K520Q (MUT ID: 881) was increased 3.1 fold. Activity increases were also found in combinations with other mutations. For example, the activity of the PHI-4 polypeptide having the R097D and K520E substitutions (SEQ ID NO: 52) is 3.5 fold higher than that of PHI-4-R097D (MUT ID: 8) alone by FAE assay.

Example 16: Saturation Mutagenesis of Amino Acid Residues Selected by Site Directed Single Amino Acid Mutagenesis Certain amino acid residues showed activity changes when mutated by site directed single amino acid mutagenesis. Those residues were "Selected" for saturation mutagenesis. For the purposes of this example, "Selected" can refer to single amino acid mutations that affect the activity, positively or negatively, relative to the parental backbone in which they were made. More specifically substitutions of Table 8 with Mean FAE Indices of <0.7 or of >1.3 are deemed "Selected". For example, Selected amino acid residues were found by performing site directed mutagenesis at certain residues such as Arg and Lys. These basic amino acid residues were mutated to either acidic (Asp, Glu) or neutral, polar (e.g.: Asn and Gln) residues, and the activity of those mutants was determined by the FAE insect assay individually. Acidic amino acid residues such as Asp and Glu were changed to basic (e.g.: Arg, Lys) or neutral, polar (e.g.: Asn and Gln) residues and the mutant activity was determined. Neutral, polar amino acid residues such as Gln and Asn were mutated to either acidic (Asp, Glu) or basic (e.g.: Arg, Lys) amino acid residues to see if the activity of those mutants were changed positively (for example mean FAE Index>1.3 relative to the reference protein) or negatively (for example mean FAE Index<0.7 relative to the reference sequence). Another example of finding Selected amino acid residues is based on the sequence-function relationship. Since AXMI-205 is a member of the perforin family it is possible to identify amino acid residues of PHI-4 polypeptide of SEQ ID NO: 2 which are involved in the mode of action elements such as membrane insertion initiation and receptor binding loops. Amino acid residues found in those regions were considered Selected for saturation mutagenesis in this Example. One can use the alanine scanning to empirically define Selected residues. This technique was used to find additional Selected amino acid residues in the putative receptor binding loops.

After any amino acid residues were determined Selected, those residues were subjected to saturation or near saturation mutagenesis to produce a set of up to 19 mutants for each site (20 all possible amino acids minus the amino acid found in the wild type). The insecticidal activity of all these mutants was determined by the FAE insect assay. Saturation mutagenesis of the Selected amino acid residues, was useful for identifying substitutions with Mean FAE Indices of >1, in many cases>1.3. When the activity of one single amino acid mutation was found to be positive by showing increased activity over the PHI-4 polypeptide of SEQ ID NO: 2, the saturation mutagenesis enabled us to find other mutation(s) that showed further increased activity. For example, while the FAE Index of E082Q (MUT ID: 370) was positive (1.37), the saturation mutagenesis at this site revealed other mutations showing much higher FAE Indices. For example, the index of E0821 (MUT ID: 219) was 7.80 and that of E082L (MUT ID: 259) was 2.71 indicating that PHI-4 polypeptide of SEQ ID NO: 2 hydrophobic residues are beneficial at this site as far as its insecticidal activity is concerned.

Other Selected amino acid substitutions resulted in decreased activity. When these sites were examined further by saturation mutagenesis, substitutions with Mean FAE Indices of >1 were observed. For example, the FAE Indices of K099Q (MUT ID: 677), K099E (MUT ID: 715) were 0.34 and 0.26, respectively. This shows that Lysine at this site is functionally involved in activity and that alternative substitutions may result in improved activity. In this example, the saturation mutagenesis revealed substitutions with Mean FAE Index>1. For example, the substitution K099L (MUT ID: 299) has a Mean FAE Index of 5.72 (Table 8). Similar instances were found across the entire PHI-4 polypeptide of SEQ ID NO: 2, for example those indicated in Table 7. Table 7 shows the Mean FAE Indices for nine pairs of substitutions. All data is from Table 8.

TABLE 7

| Substitution A | | | Substitution B | | |
|---|---|---|---|---|---|
| MUT ID | Substitution | mean FAE Index | MUT ID | Substitution | mean FAE Index |
| 570 | K074Q | 0.7 | 215 | K074E | 12.40 |
| 596 | E203Q | 0.59 | 288 | E203T | 2.18 |
| 800 | R235Q | 0.06 | 497 | R235K | 1.34 |
| 906 | K313E | 0.14 | 889 | K313Q | 2.29 |
| 838 | D395Q | 0.03 | 832 | D395R | 1.60 |
| 784 | S398A | 0.11 | 342 | S398Q | 1.51 |
| 629 | K402Q | 0.47 | 216 | K402F | 10.20 |
| 842 | D403Q | 0.03 | 251 | D403Y | 3.03 |
| 611 | D447Q | 0.54 | 211 | D447K | 31.70 |

The serine at position 98 of SEQ ID NO: 2 was selected by alanine scanning amino acid residues found in a region of the protein that is suspected overlap with the receptor binding loops. Point mutants with improved potency may then be used to prepare and screen combinatorial libraries based on that diversity.

Taking mean FAE Index<0.7 as a definition of Selected, the following positions are deemed Selected: P14, D24, Q38, E53, R55, R61, Q75, D76, E83, E118, E126, D152, R166, K188, K191, D193, K242, P243, R248, D254, L266, D268, A270, D274, D298, K313, D315, K316, D321, V343, S349, Q360, R361, D368, I373, D376, F378, D379, D394, Y404, Q413, N430, Q449, D497, R500, S504. Saturation or near saturation mutagenesis at these positions can be performed by the method of Example 7 or equivalent methods and purified and screened the variant proteins for activity by the methods of Example 2 & 3 or equivalent methods.

Example 17: Transgenic Expression and Activity Evaluation

Figure 5:
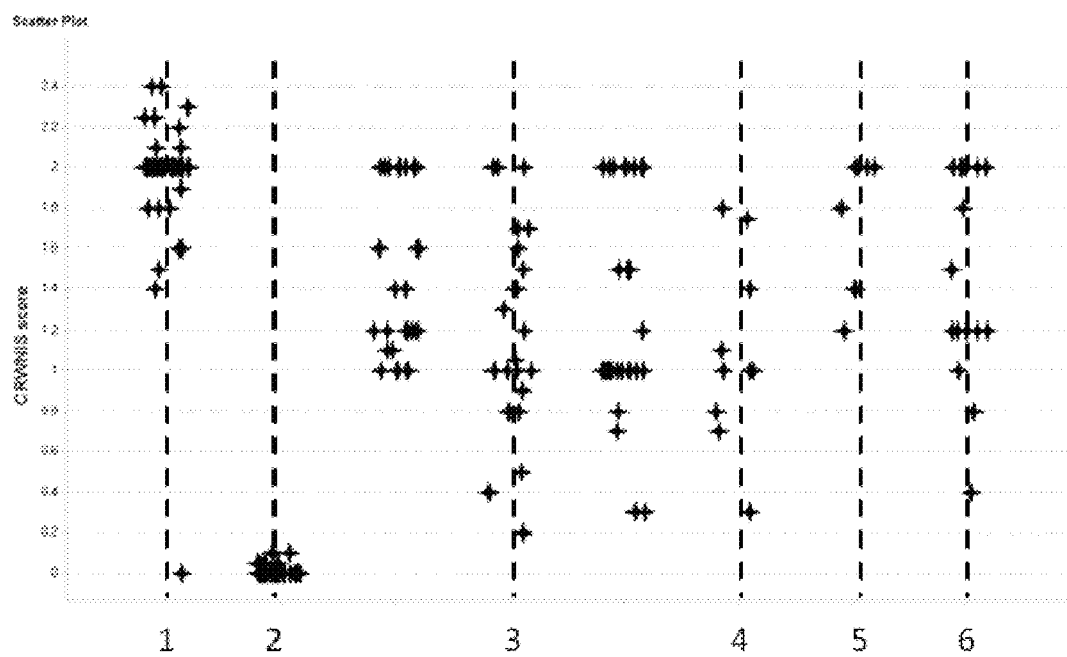

The polynucleotides encoding PHI-4 polypeptides of SEQ ID NOs: 22-25 were cloned under control of the maize ubiquitin promoter (Christensen and Quail, (1996) Transgenic Research 5:213-218) into a standard vector suitable for transformation of maize by *Agrobacterium*. Transgenic maize plants were produced by the method of Example 20. Selected T0 plants were tested for susceptibility to WCRW feeding by challenging T0 plants with WCRW larvae. After 19-21 days of challenge, the roots were visually examined and root nodal injury scores were recorded as described (Oleson J. et al *J. Economic Entomology* 98:1-8; 2005). Root nodal injury scores are indicated in FIG. 5. The data support the conclusion that the three PHI-4 polypeptide variants provide measurable in planta efficacy for protection of maize transgenic plants against WCRW. FIG. 5 shows the T0 seedlings in the V3-V4 growth stage were challenged as described (Oleson J. et al *J. Economic Entomology* 98:1-8; 2005) and root nodal injury scores were recorded.

Example 18: In Planta Expression of Fusion Proteins

Localization of the protein can also play an important role in in planta accumulation. One can direct proteins such as PHI-4 polypeptides to the chloroplast using a chloroplast targeting peptide (CTP). Additionally, one can direct expression to the apoplastic space using fusions to peptides such as the barley alpha amylase-derived peptide (BAA; SEQ ID NO: 1513). One may also direct transgenically expressed proteins for retention in the endoplasmic reticulum by fusing to both BAA and the sequence "KDEL" (SEQ ID NO: 1514). Proteins can also be directed to the vacuolar space by fusion with the C terminal peptide from plant defensins such as the maize defensin 20 C-terminal propeptide (SEQ ID NO: 511). Other functionally equivalent gene elements may be combined in a similar manner. One may also direct expression specifically to the roots with root-specific promoters. Each of these modifications may be made separately or in combination and any given combination of elements to improve accumulation of protein in plant tissue or in functionally improved efficacy of the expressed protein.

Example 19: Transformation of Maize by Particle Bombardment and Regeneration of Transgenic Plants Immature maize embryos from greenhouse donor plants are bombarded with a DNA molecule containing the PHI-4 polypeptide of nucleotide sequence (e.g., SEQ ID NO: 1) operably linked to an ubiquitin promoter and the selectable marker gene PAT (Wohlleben, et al., (1988) *Gene* 70: 25-37), which confers resistance to the herbicide Bialaphos. Alternatively, the selectable marker gene is provided on a separate DNA molecule. Transformation is performed as follows. Media recipes follow below.

Preparation of Target Tissue

The ears are husked and surface sterilized in 30% CLOROX™ bleach plus 0.5% Micro detergent for 20 minutes, and rinsed two times with sterile water. The immature embryos are excised and placed embryo axis side down (scutellum side up), 25 embryos per plate, on 560Y medium for 4 hours and then aligned within the 2.5 cm target zone in preparation for bombardment.

Preparation of DNA

A plasmid vector comprising a nucleotide sequence (e.g., SEQ ID NO: 1) operably linked to an ubiquitin promoter is made. For example, a suitable transformation vector comprises a UBI1 promoter from *Zea mays*, a 5' UTR from UBI1 and a UBI1 intron, in combination with a PinII terminator. The vector additionally contains a PAT selectable marker gene driven by a CAMV35S promoter and includes a CAMV35S terminator. Optionally, the selectable marker can reside on a separate plasmid. A DNA molecule comprising a toxin nucleotide sequence as well as a PAT selectable marker is precipitated onto 1.1 µm (average diameter) tungsten pellets using a $CaCl_2$ precipitation procedure as follows:

100 µL prepared tungsten particles in water
10 µL (1 µg) DNA in Tris EDTA buffer (1 µg total DNA)
100 µL 2.5 M $CaCl_2$
10 µL 0.1 M spermidine Each reagent is added sequentially to a tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 mL 100% ethanol, and centrifuged for 30 seconds. Again the liquid is removed, and 105 µL 100% ethanol is added to the final tungsten particle pellet. For particle gun bombardment, the tungsten/DNA particles are briefly sonicated and 10 µL spotted onto the center of each macrocarrier and allowed to dry about 2 minutes before bombardment.

Particle Gun Treatment

The sample plates are bombarded at level #4 in particle gun #HE34-1 or #HE34-2. All samples receive a single shot at 650 PSI, with a total of ten aliquots taken from each tube of prepared particles/DNA.

Subsequent Treatment

Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for expression of the toxin by assays known in the art or as described above.

Bombardment and Culture Media

Bombardment medium (560Y) comprises 4.0 g/L N6 basal salts (SIGMA C-1416), 1.0 mL/L Eriksson's Vitamin Mix (1000× SIGMA-1511), 0.5 mg/L thiamine HCl, 120.0 g/L sucrose, 1.0 mg/L 2,4-D and 2.88 g/L L-proline (brought to volume with deionized $H_2O$ following adjustment to pH 5.8 with KOH); 2.0 g/L Gelrite™ (added after bringing to volume with dl $H_2O$); and 8.5 mg/L silver nitrate (added after sterilizing the medium and cooling to room temperature). Selection medium (560R) comprises 4.0 g/L N6 basal salts (SIGMA C-1416), 1.0 mL/L Eriksson's Vitamin Mix (1000× SIGMA-1511), 0.5 mg/L thiamine HCl, 30.0 g/L sucrose, and 2.0 mg/L 2,4-D (brought to volume with dl $H_2O$ following adjustment to pH 5.8 with KOH); 3.0 g/L Gelrite™ (added after bringing to volume with dl $H_2O$); and 0.85 mg/L silver nitrate and 3.0 mg/L Bialaphos (both added after sterilizing the medium and cooling to room temperature).

Plant regeneration medium (288J) comprises 4.3 g/L MS salts (GIBCO 11117-074), 5.0 mL/L MS vitamins stock solution (0.100 g nicotinic acid, 0.02 g/L thiamine HCl, 0.10 g/L pyridoxine HCl, and 0.40 g/L Glycine brought to volume with polished D-1 $H_2O$) (Murashige and Skoog, (1962) *Physiol. Plant.* 15:473), 100 mg/L myo-inositol, 0.5 mg/L zeatin, 60 g/L sucrose, and 1.0 mL/L of 0.1 mM abscisic acid (brought to volume with polished dl H₂O after adjusting to pH 5.6); 3.0 g/L Gelrite™ (added after bringing to volume with dl H₂O); and 1.0 mg/L indoleacetic acid and 3.0 mg/L Bialaphos (added after sterilizing the medium and cooling to 60 C).

Hormone-free medium (272V) comprises 4.3 g/L MS salts (GIBCO 11117-074), 5.0 mL/L MS vitamins stock solution (0.100 g/L nicotinic acid, 0.02 g/L thiamine HCl, 0.10 g/L pyridoxine HCl, and 0.40 g/L Glycine brought to volume with polished dl H₂O), 0.1 g/L myo-inositol, and 40.0 g/L sucrose (brought to volume with polished dl H₂O after adjusting pH to 5.6); and 6 g/L Bacto-agar (added after bringing to volume with polished dl H₂O), sterilized and cooled to 60° C.

Example 20: *Agrobacterium*-Mediated Transformation of Maize and Regeneration of Transgenic Plants For *Agrobacterium*-mediated transformation of maize with a toxin nucleotide sequence (e.g., SEQ ID NO: 1), the method of Zhao can be used (U.S. Pat. No. 5,981,840 and PCT Patent Publication Number WO 1998/32326; the contents of which are hereby incorporated by reference). Briefly, immature embryos are isolated from maize and the embryos contacted with a suspension of *Agrobacterium* under conditions whereby the bacteria are capable of transferring the nucleotide sequence (e.g. SEQ ID NO: 1) to at least one cell of at least one of the immature embryos (step 1: the infection step). In this step the immature embryos can be immersed in an *Agrobacterium* suspension for the initiation of inoculation. The embryos are co-cultured for a time with the *Agrobacterium* (step 2: the co-cultivation step). The immature embryos can be cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformants (step 3: resting step). The immature embryos can be cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium can be cultured on solid medium to regenerate the plants.

TABLE 8

Table Legends

Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 1 | PHI-4 | 202 | A | V | | | 154 | 0.45 | 4 |
| 2 | PHI-4 | 342 | A | S | | | 129 | 0.32 | 4 |
| 3 | PHI-4 | 417 | A | S | | | 96 | −0.13 | 4 |
| 4 | PHI-4 | 24 | D | N | | | 96 | 0.23 | 4 |
| 5 | PHI-4 | 42 | D | N | | | 100 | 0.62 | 4 |
| 6 | PHI-4 | 331 | E | D | | | 122 | −0.02 | 4 |
| 7 | PHI-4 | 109 | F | I | | | 202 | | 4 |
| 8 | PHI-4 | 300 | F | Y | | | 132 | 0.26 | 4 |
| 9 | PHI-4 | 359 | G | A | | | 98 | −0.06 | 4 |
| 10 | PHI-4 | 52 | I | V | | | 202 | | 4 |
| 11 | PHI-4 | 133 | I | L | | | 124 | −0.21 | 4 |
| 12 | PHI-4 | 172 | I | L | | | 123 | 0.26 | 4 |
| 13 | PHI-4 | 283 | I | V | | | 187 | | 4 |
| 14 | PHI-4 | 410 | I | V | | | 100 | 0.05 | 4 |
| 15 | PHI-4 | 40 | L | I | | | 113 | | 4 |
| 16 | PHI-4 | 145 | L | V | | | 102 | | 4 |
| 17 | PHI-4 | 153 | L | I | | | 79 | 0.22 | 4 |
| 18 | PHI-4 | 163 | L | V | | | 104 | | 4 |
| 19 | PHI-4 | 296 | L | I | | | 116 | 0.36 | 4 |
| 20 | PHI-4 | 418 | L | M | | | 84 | 0.1 | 4 |
| 21 | PHI-4 | 154 | N | D | | | 108 | 0.01 | 4 |
| 22 | PHI-4 | 346 | P | A | | | 85 | | 4 |
| 23 | PHI-4 | 411 | P | A | | | 91 | 0.06 | 4 |
| 24 | PHI-4 | 412 | P | A | | | 79 | 0.2 | 4 |
| 25 | PHI-4 | 34 | S | A | | | 176 | | 4 |
| 26 | PHI-4 | 78 | S | G | | | 144 | −0.23 | 4 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 27 | PHI-4 | 335 | S | T | | | 160 | −0.26 | 4 |
| 28 | PHI-4 | 426 | T | S | | | 93 | −0.13 | 4 |
| 29 | PHI-4 | 461 | T | S | | | 54 | | 4 |
| 30 | PHI-4 | 343 | V | I | | | 89 | 0.39 | 4 |
| 31 | PHI-4 | 355 | V | I | | | 78 | 0.39 | 4 |
| 32 | PHI-4 | 392 | V | I | | | 121 | | 4 |
| 33 | PHI-4 | 421 | V | L | | | 106 | | 4 |
| 34 | PHI-4 | 440 | V | L | | | 75 | 0.26 | 4 |
| 35 | PHI-4 | 456 | W | Y | | | 199 | | 4 |
| 36 | PHI-4 | 98 | Y | F | | | 71 | | 4 |
| 37 | PHI-4 | 121 | Y | F | | | 117 | 0.11 | 4 |
| 38 | PHI-4 | 206 | Y | F | | | 82 | 0.51 | 4 |
| 39 | PHI-4 | 337 | A | G | | | | −0.1 | 4 |
| 40 | PHI-4 | 364 | A | S | | | | 0.09 | 4 |
| 41 | PHI-4 | 371 | A | G | | | | 0.02 | 4 |
| 42 | PHI-4 | 371 | A | T | | | | 0.24 | 4 |
| 43 | PHI-4 | 385 | A | G | | | | 0.08 | 4 |
| 44 | PHI-4 | 385 | A | P | | | | −0.23 | 4 |
| 45 | PHI-4 | 396 | A | E | | | | −0.56 | 4 |
| 46 | PHI-4 | 405 | A | S | | | | 0.09 | 4 |
| 47 | PHI-4 | 405 | A | W | | | | −0.38 | 4 |
| 48 | PHI-4 | 409 | A | P | | | | 0.25 | 4 |
| 49 | PHI-4 | 417 | A | C | | | | 0.11 | 4 |
| 50 | PHI-4 | 445 | C | L | | | | 0.16 | 4 |
| 51 | PHI-4 | 445 | C | T | | | | 0.06 | 4 |
| 52 | PHI-4 | 331 | E | N | | | | 0.24 | 4 |
| 53 | PHI-4 | 339 | E | N | | | | 0.04 | 4 |
| 54 | PHI-4 | 339 | E | Q | | | | 0.34 | 4 |
| 55 | PHI-4 | 344 | F | W | | | | 0.16 | 4 |
| 56 | PHI-4 | 374 | F | I | | | | 0.1 | 4 |
| 57 | PHI-4 | 378 | F | I | | | | −0.78 | 4 |
| 58 | PHI-4 | 351 | G | V | | | | 0.1 | 4 |
| 59 | PHI-4 | 397 | G | R | | | | 0.29 | 4 |
| 60 | PHI-4 | 428 | G | S | | | | −0.17 | 4 |
| 61 | PHI-4 | 373 | I | V | | | | −0.52 | 4 |
| 62 | PHI-4 | 375 | K | R | | | | 0.19 | 4 |
| 63 | PHI-4 | 384 | K | A | | | | 0.05 | 4 |
| 64 | PHI-4 | 341 | L | V | | | | 0.19 | 4 |
| 65 | PHI-4 | 380 | L | G | | | | 0.17 | 4 |
| 66 | PHI-4 | 383 | L | I | | | | 0.07 | 4 |
| 67 | PHI-4 | 383 | L | V | | | | 0.17 | 4 |
| 68 | PHI-4 | 354 | M | L | | | | 0.29 | 4 |
| 69 | PHI-4 | 422 | M | V | | | | 0.05 | 4 |
| 70 | PHI-4 | 345 | N | H | | | | 0.08 | 4 |
| 71 | PHI-4 | 362 | N | S | | | | 0.2 | 4 |
| 72 | PHI-4 | 430 | N | D | | | | −0.7 | 4 |
| 73 | PHI-4 | 453 | N | D | | | | 0.02 | 4 |
| 74 | PHI-4 | 372 | P | L | | | | −0.13 | 4 |
| 75 | PHI-4 | 390 | Q | D | | | | −0.36 | 4 |
| 76 | PHI-4 | 452 | Q | G | | | | −0.1 | 4 |
| 77 | PHI-4 | 391 | R | L | | | | 0.16 | 4 |
| 78 | PHI-4 | 333 | S | E | | | | −0.34 | 4 |
| 79 | PHI-4 | 333 | S | R | | | | 0.14 | 4 |
| 80 | PHI-4 | 349 | S | F | | | | −0.53 | 4 |
| 81 | PHI-4 | 349 | S | P | | | | −0.9 | 4 |
| 82 | PHI-4 | 398 | S | G | | | | −0.71 | 4 |
| 83 | PHI-4 | 427 | S | N | | | | −0.08 | 4 |
| 84 | PHI-4 | 427 | S | T | | | | −0.22 | 4 |
| 85 | PHI-4 | 343 | V | F | | | | −0.81 | 4 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 86 | PHI-4 | 355 | V | L | | | | 0.09 | 4 |
| 87 | PHI-4 | 382 | V | D | | | | 0.23 | 4 |
| 88 | PHI-4 | 382 | V | L | | | | 0.16 | 4 |
| 89 | PHI-4 | 387 | V | T | | | | −0.33 | 4 |
| 90 | PHI-4 | 392 | V | L | | | | −0.26 | 4 |
| 91 | PHI-4 | 438 | V | R | | | | 0.28 | 4 |
| 92 | PHI-4 | 455 | V | I | | | | 0.81 | 4 |
| 93 | PHI-4 | 389 | W | F | | | | −0.06 | 4 |
| 94 | PHI-4 | 389 | W | Y | | | | 0.19 | 4 |
| 95 | PHI-4 | 457 | W | N | | | | 0.34 | 4 |
| 96 | PHI-4 | 352 | Y | C | | | | −0.34 | 4 |
| 97 | PHI-4 | 352 | Y | F | | | | −0.2 | 4 |
| 98 | PHI-4 | 404 | Y | F | | | | −0.04 | 4 |
| 99 | PHI-4 | 404 | Y | G | | | | −0.7 | 4 |
| 100 | PHI-4 | 429 | Y | E | | | | −0.36 | 4 |
| 101 | PHI-4 | 437 | Y | I | | | | −0.01 | 4 |
| 102 | PHI-4 | 437 | Y | V | | | | 0.05 | 4 |
| 103 | PHI-4 | 30 | A | C | | | | −0.08 | 4 |
| 104 | PHI-4 | 103 | A | G | | | | 0.03 | 4 |
| 105 | PHI-4 | 127 | A | T | | | | 0.1 | 4 |
| 106 | PHI-4 | 185 | A | S | | | | 0.28 | 4 |
| 107 | PHI-4 | 238 | A | T | | | | −0.24 | 4 |
| 108 | PHI-4 | 263 | A | S | | | | −0.01 | 4 |
| 109 | PHI-4 | 270 | A | P | | | | −0.6 | 4 |
| 110 | PHI-4 | 287 | A | C | | | | 0.37 | 4 |
| 111 | PHI-4 | 182 | D | Q | | | | 0.5 | 4 |
| 112 | PHI-4 | 193 | D | N | | | | 0.32 | 4 |
| 113 | PHI-4 | 268 | D | N | | | | 0.08 | 4 |
| 114 | PHI-4 | 46 | E | D | | | | 0.47 | 4 |
| 115 | PHI-4 | 46 | E | N | | | | 0.67 | 4 |
| 116 | PHI-4 | 80 | E | S | | | | 0.27 | 4 |
| 117 | PHI-4 | 83 | E | S | | | | −0.62 | 4 |
| 118 | PHI-4 | 162 | E | D | | | | 0.28 | 4 |
| 119 | PHI-4 | 278 | E | N | | | | 0.61 | 4 |
| 120 | PHI-4 | 43 | F | E | | | | 0.53 | 4 |
| 121 | PHI-4 | 73 | F | Y | | | | 0.01 | 4 |
| 122 | PHI-4 | 149 | F | A | | | | −0.05 | 4 |
| 123 | PHI-4 | 149 | F | V | | | | 0.25 | 4 |
| 124 | PHI-4 | 303 | F | Y | | | | 0.08 | 4 |
| 125 | PHI-4 | 22 | G | S | | | | 0.07 | 4 |
| 126 | PHI-4 | 50 | I | V | | | | 0.31 | 4 |
| 127 | PHI-4 | 119 | I | N | | | | −0.22 | 4 |
| 128 | PHI-4 | 213 | I | L | | | | −0.05 | 4 |
| 129 | PHI-4 | 207 | K | A | | | | −0.4 | 4 |
| 130 | PHI-4 | 214 | K | S | | | | 0.11 | 4 |
| 131 | PHI-4 | 36 | L | M | | | | 0.12 | 4 |
| 132 | PHI-4 | 100 | L | F | | | | −0.31 | 4 |
| 133 | PHI-4 | 105 | L | I | | | | 0.22 | 4 |
| 134 | PHI-4 | 141 | L | H | | | | −0.34 | 4 |
| 135 | PHI-4 | 181 | L | A | | | | −0.33 | 4 |
| 136 | PHI-4 | 266 | L | I | | | | −0.73 | 4 |
| 137 | PHI-4 | 266 | L | V | | | | −0.47 | 4 |
| 138 | PHI-4 | 19 | M | I | | | | −0.04 | 4 |
| 139 | PHI-4 | 19 | M | L | | | | 0.31 | 4 |
| 140 | PHI-4 | 88 | M | I | | | | 0.2 | 4 |
| 141 | PHI-4 | 88 | M | L | | | | 0 | 4 |
| 142 | PHI-4 | 204 | M | A | | | | 0.1 | 4 |
| 143 | PHI-4 | 245 | M | L | | | | 0.34 | 4 |
| 144 | PHI-4 | 155 | N | K | | | | 0.11 | 4 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 145 | PHI-4 | 231 | N | S | | | | 0.32 | 4 |
| 146 | PHI-4 | 14 | P | A | | | | 0.13 | 4 |
| 147 | PHI-4 | 159 | P | D | | | | 0.2 | 4 |
| 148 | PHI-4 | 243 | P | L | | | | −0.54 | 4 |
| 149 | PHI-4 | 282 | P | G | | | | 0.26 | 4 |
| 150 | PHI-4 | 55 | R | K | | | | 0.3 | 4 |
| 151 | PHI-4 | 61 | R | K | | | | 0.24 | 4 |
| 152 | PHI-4 | 97 | R | N | | | | 0.59 | 4 |
| 153 | PHI-4 | 292 | R | Q | | | | 0.27 | 4 |
| 154 | PHI-4 | 56 | S | T | | | | 0.36 | 4 |
| 155 | PHI-4 | 173 | S | A | | | | 0.29 | 4 |
| 156 | PHI-4 | 184 | S | T | | | | 0.27 | 4 |
| 157 | PHI-4 | 219 | S | N | | | | −0.4 | 4 |
| 158 | PHI-4 | 230 | S | E | | | | 0.11 | 4 |
| 159 | PHI-4 | 276 | S | A | | | | 0.36 | 4 |
| 160 | PHI-4 | 279 | S | P | | | | −0.35 | 4 |
| 161 | PHI-4 | 58 | T | S | | | | 0.09 | 4 |
| 162 | PHI-4 | 112 | T | S | | | | 0.04 | 4 |
| 163 | PHI-4 | 117 | T | S | | | | 0.18 | 4 |
| 164 | PHI-4 | 189 | T | K | | | | 0.08 | 4 |
| 165 | PHI-4 | 94 | V | I | | | | 0.18 | 4 |
| 166 | PHI-4 | 210 | V | I | | | | 0.41 | 4 |
| 167 | PHI-4 | 57 | Y | F | | | | 0.26 | 4 |
| 168 | PHI-4 | 167 | Y | W | | | | 0.08 | 4 |
| 169 | PHI-4 | 170 | Y | H | | | | 0.23 | 4 |
| 170 | PHI-4 | 171 | Y | F | | | | 1.29 | 4 |
| 171 | PHI-4 | 183 | Y | V | | | | 0.05 | 4 |
| 172 | PHI-4 | 186 | A | V | | | | −0.34 | 4 |
| 173 | PHI-4 | 342 | A | V | | | | 0.24 | 4 |
| 174 | PHI-4 | 445 | C | S | | | | −0.24 | 4 |
| 175 | PHI-4 | 321 | D | E | | | | −0.27 | 4 |
| 176 | PHI-4 | 46 | E | G | | | | 0.02 | 4 |
| 177 | PHI-4 | 222 | E | G | | | | −0.34 | 4 |
| 178 | PHI-4 | 297 | E | G | | | | −0.42 | 4 |
| 179 | PHI-4 | 344 | F | Y | | | | −0.07 | 4 |
| 180 | PHI-4 | 483 | F | S | | | | −0.19 | 4 |
| 181 | PHI-4 | 66 | H | R | | | | 0 | 4 |
| 182 | PHI-4 | 441 | H | R | | | | −0.13 | 4 |
| 183 | PHI-4 | 172 | I | V | | | | 0.07 | 4 |
| 184 | PHI-4 | 384 | K | G | | | | 0.19 | 4 |
| 185 | PHI-4 | 465 | K | E | | | | −0.19 | 4 |
| 186 | PHI-4 | 209 | L | P | | | | 0.4 | 4 |
| 187 | PHI-4 | 236 | L | P | | | | 0.44 | 4 |
| 188 | PHI-4 | 144 | M | I | | | | −0.03 | 4 |
| 189 | PHI-4 | 158 | M | R | | | | −0.4 | 4 |
| 190 | PHI-4 | 12 | N | D | | | | −0.28 | 4 |
| 191 | PHI-4 | 155 | N | D | | | | −0.02 | 4 |
| 192 | PHI-4 | 350 | N | S | | | | 0.08 | 4 |
| 193 | PHI-4 | 14 | P | L | | | | −1.16 | 4 |
| 194 | PHI-4 | 115 | Q | L | | | | −0.14 | 4 |
| 195 | PHI-4 | 306 | Q | L | | | | −0.39 | 4 |
| 196 | PHI-4 | 309 | Q | R | | | | −0.3 | 4 |
| 197 | PHI-4 | 134 | S | G | | | | −0.21 | 4 |
| 198 | PHI-4 | 195 | S | N | | | | −0.02 | 4 |
| 199 | PHI-4 | 504 | S | C | | | | −0.59 | 4 |
| 200 | PHI-4 | 189 | T | I | | | | 0.26 | 4 |
| 201 | PHI-4 | 233 | T | A | | | | −0.33 | 4 |
| 202 | PHI-4 | 16 | V | D | | | | 0.03 | 4 |
| 203 | PHI-4 | 294 | V | A | | | | 0.03 | 4 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 204 | PHI-4 | 355 | V | G | | | | −0.31 | 4 |
| 205 | PHI-4 | 438 | V | A | | | | −0.15 | 4 |
| 206 | PHI-4 | 448 | V | A | | | | 0.05 | 4 |
| 207 | PHI-4 | 284 | W | R | | | | 0.11 | 4 |
| 208 | PHI-4 | 84 | Y | F | | | | 0.35 | 4 |
| 209 | PHI-4 | 167 | Y | C | | | | 0.1 | 4 |
| 210 | PHI-4 | 97 | R | D | 125.8 | 0.01 | | | 5 |
| 211 | PHI-4 | 447 | D | K | 31.7 | 0.598 | | | 5 |
| 212 | PHI-4 | 334 | G | R | 25.2 | 0 | | | 5 |
| 213 | PHI-4 | 527 | Q | K | 25 | 0 | | | 5 |
| 214 | PHI-4 | 109 | F | K | 14.3 | 0 | | | 5 |
| 215 | PHI-4 | 74 | K | E | 12.4 | 0.152 | | | 5 |
| 216 | PHI-4 | 402 | K | F | 10.2 | 0 | | | 5 |
| 217 | PHI-4 | 336 | G | A | 8 | 0 | | | 5 |
| 218 | PHI-4 | 527 | Q | P | 7.8 | 0 | | | 5 |
| 219 | PHI-4 | 82 | E | I | 7.8 | 0.086 | | | 5 |
| 220 | PHI-4 | 109 | F | G | 6.8 | 0.151 | | | 5 |
| 221 | PHI-4 | 97 | R | E | 6.7 | 0 | | | 5 |
| 222 | PHI-4 | 220 | E | H | 6.6 | 0 | | | 5 |
| 223 | PHI-4 | 165 | K | E | 6.6 | 0 | | | 5 |
| 224 | PHI-4 | 289 | K | L | 6.6 | 0 | | | 5 |
| 225 | PHI-4 | 454 | R | Y | 6.4 | 0 | | | 5 |
| 226 | PHI-4 | 109 | F | M | 6.4 | 0 | | | 5 |
| 227 | PHI-4 | 247 | D | Y | 6.1 | 0 | | | 5 |
| 228 | PHI-4 | 454 | R | M | 5.8 | 0 | | | 5 |
| 229 | PHI-4 | 99 | K | L | 5.7 | 0 | | | 5 |
| 230 | PHI-4 | 289 | K | V | 5.1 | 0 | | | 5 |
| 231 | PHI-4 | 109 | F | S | 5 | 0.374 | | | 5 |
| 232 | PHI-4 | 289 | K | P | 5 | 0 | | | 5 |
| 233 | PHI-4 | 454 | R | S | 4.6 | 0 | | | 5 |
| 234 | PHI-4 | 220 | E | D | 4.4 | 0 | | | 5 |
| 235 | PHI-4 | 334 | G | K | 4.3 | 0.395 | | | 5 |
| 236 | PHI-4 | 459 | K | M | 4.2 | 0 | | | 5 |
| 237 | PHI-4 | 97 | R | Q | 4 | 0 | | | 5 |
| 238 | PHI-4 | 454 | R | V | 4 | 0.001 | | | 5 |
| 239 | PHI-4 | 517 | Q | I | 4 | 0.006 | | | 5 |
| 240 | PHI-4 | 99 | K | Y | 4 | 0 | | | 5 |
| 241 | PHI-4 | 256 | Q | K | 4 | 0.192 | | | 5 |
| 242 | PHI-4 | 109 | F | D | 3.9 | 0.596 | | | 5 |
| 243 | PHI-4 | 220 | E | T | 3.8 | 0 | | | 5 |
| 244 | PHI-4 | 196 | Q | K | 3.7 | 0.08 | | | 5 |
| 245 | PHI-4 | 517 | Q | F | 3.7 | 0.001 | | | 5 |
| 246 | PHI-4 | 79 | K | E | 3.6 | 0.006 | | | 5 |
| 247 | PHI-4 | 454 | R | I | 3.5 | 0.002 | | | 5 |
| 248 | PHI-4 | 454 | R | K | 3.5 | 0.001 | | | 5 |
| 249 | PHI-4 | 289 | K | E | 3.3 | 0.994 | | | 5 |
| 250 | PHI-4 | 74 | K | G | 3.3 | 0 | | | 5 |
| 251 | PHI-4 | 403 | D | Y | 3.3 | 0 | | | 5 |
| 252 | PHI-4 | 166 | R | Q | 3.3 | 0.992 | | | 5 |
| 253 | PHI-4 | 517 | Q | K | 3.3 | 0.162 | | | 5 |
| 254 | PHI-4 | 447 | D | Y | 3.2 | 0 | | | 5 |
| 255 | PHI-4 | 289 | K | Q | 2.8 | 0.028 | | | 5 |
| 256 | PHI-4 | 454 | R | F | 2.8 | 0.011 | | | 5 |
| 257 | PHI-4 | 220 | E | Y | 2.7 | 0.003 | | | 5 |
| 258 | PHI-4 | 447 | D | S | 2.7 | 0 | | | 5 |
| 259 | PHI-4 | 82 | E | L | 2.7 | 0.881 | | | 5 |
| 260 | PHI-4 | 196 | Q | N | 2.7 | 0 | | | 5 |
| 261 | PHI-4 | 216 | E | Q | 2.7 | 0.017 | | | 5 |
| 262 | PHI-4 | 334 | G | I | 2.6 | 0.893 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 263 | PHI-4 | 151 | D | S | 2.6 | 0.001 | | | 5 |
| 264 | PHI-4 | 454 | R | W | 2.6 | 0.005 | | | 5 |
| 265 | PHI-4 | 165 | K | Q | 2.6 | 0.878 | | | 5 |
| 266 | PHI-4 | 459 | K | V | 2.6 | 0.024 | | | 5 |
| 267 | PHI-4 | 148 | D | F | 2.6 | 0.001 | | | 5 |
| 268 | PHI-4 | 220 | E | V | 2.5 | 0.016 | | | 5 |
| 269 | PHI-4 | 454 | R | Q | 2.5 | 0.068 | | 0.26 | 5 |
| 270 | PHI-4 | 447 | D | E | 2.5 | 0 | | | 5 |
| 271 | PHI-4 | 527 | Q | C | 2.5 | 0.001 | | | 5 |
| 272 | PHI-4 | 196 | Q | D | 2.5 | 0.004 | | | 5 |
| 273 | PHI-4 | 82 | E | Y | 2.5 | 0.938 | | | 5 |
| 274 | PHI-4 | 527 | Q | E | 2.4 | 0.423 | | | 5 |
| 275 | PHI-4 | 402 | K | H | 2.4 | 0.016 | | | 5 |
| 276 | PHI-4 | 459 | K | W | 2.4 | 0.043 | | | 5 |
| 277 | PHI-4 | 459 | K | Q | 2.3 | 0.116 | | | 5 |
| 278 | PHI-4 | 289 | K | Y | 2.3 | 0.027 | | | 5 |
| 279 | PHI-4 | 99 | K | I | 2.3 | 0.024 | | | 5 |
| 280 | PHI-4 | 289 | K | T | 2.3 | 0.031 | | | 5 |
| 281 | PHI-4 | 220 | E | S | 2.3 | 0.037 | | | 5 |
| 282 | PHI-4 | 459 | K | I | 2.3 | 0.049 | | | 5 |
| 283 | PHI-4 | 462 | G | A | 2.3 | 0.017 | | | 5 |
| 284 | PHI-4 | 99 | K | M | 2.2 | 0.025 | | | 5 |
| 285 | PHI-4 | 289 | K | D | 2.2 | 0.032 | | | 5 |
| 286 | PHI-4 | 109 | F | N | 2.2 | 0.061 | | | 5 |
| 287 | PHI-4 | 220 | E | Q | 2.2 | 0.166 | | | 5 |
| 288 | PHI-4 | 203 | E | T | 2.2 | 0.973 | | | 5 |
| 289 | PHI-4 | 257 | Q | I | 2.1 | 0.013 | | | 5 |
| 290 | PHI-4 | 203 | E | H | 2.1 | 0.948 | | | 5 |
| 291 | PHI-4 | 151 | D | A | 2.1 | 0.017 | | | 5 |
| 292 | PHI-4 | 447 | D | I | 2.1 | 0.017 | | | 5 |
| 293 | PHI-4 | 97 | R | G | 2.1 | 0.068 | | | 5 |
| 294 | PHI-4 | 151 | D | N | 2 | 0.026 | | | 5 |
| 295 | PHI-4 | 148 | D | P | 2 | 0.001 | | | 5 |
| 296 | PHI-4 | 97 | R | S | 2 | 0.106 | | 0.45 | 5 |
| 297 | PHI-4 | 151 | D | W | 2 | 0.042 | | | 5 |
| 298 | PHI-4 | 257 | Q | E | 2 | 0.543 | | | 5 |
| 299 | PHI-4 | 109 | F | E | 2 | 0.926 | | | 5 |
| 300 | PHI-4 | 527 | Q | S | 2 | 0.282 | | | 5 |
| 301 | PHI-4 | 403 | D | W | 2 | 0.001 | | | 5 |
| 302 | PHI-4 | 518 | E | Q | 1.9 | 0.377 | | | 5 |
| 303 | PHI-4 | 460 | G | A | 1.9 | 0.124 | | | 5 |
| 304 | PHI-4 | 499 | E | Q | 1.9 | 0.395 | | | 5 |
| 305 | PHI-4 | 148 | D | V | 1.9 | 0.003 | | | 5 |
| 306 | PHI-4 | 148 | D | E | 1.9 | 0.004 | | | 5 |
| 307 | PHI-4 | 459 | K | T | 1.9 | 0.232 | | | 5 |
| 308 | PHI-4 | 289 | K | F | 1.9 | 0.158 | | | 5 |
| 309 | PHI-4 | 289 | K | S | 1.9 | 0.149 | | | 5 |
| 310 | PHI-4 | 151 | D | V | 1.9 | 0.079 | | | 5 |
| 311 | PHI-4 | 402 | K | R | 1.9 | 0.247 | | 0.08 | 5 |
| 312 | PHI-4 | 196 | Q | E | 1.8 | 0.482 | | | 5 |
| 313 | PHI-4 | 525 | Q | K | 1.8 | 0.647 | | | 5 |
| 314 | PHI-4 | 289 | K | M | 1.8 | 0.189 | | | 5 |
| 315 | PHI-4 | 302 | E | Q | 1.8 | 0.505 | | | 5 |
| 316 | PHI-4 | 403 | D | F | 1.8 | 0.009 | | | 5 |
| 317 | PHI-4 | 148 | D | H | 1.8 | 0.011 | | | 5 |
| 318 | PHI-4 | 165 | K | P | 1.8 | 0.231 | | | 5 |
| 319 | PHI-4 | 459 | K | S | 1.8 | 0.323 | | | 5 |
| 320 | PHI-4 | 24 | D | Q | 1.8 | 0.766 | | | 5 |
| 321 | PHI-4 | 151 | D | Q | 1.7 | 0.766 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 322 | PHI-4 | 289 | K | R | 1.7 | 0.256 | | | 5 |
| 323 | PHI-4 | 196 | Q | A | 1.7 | 0.142 | | | 5 |
| 324 | PHI-4 | 459 | K | H | 1.7 | 0.408 | | | 5 |
| 325 | PHI-4 | 454 | R | G | 1.7 | 0.407 | | | 5 |
| 326 | PHI-4 | 395 | D | C | 1.7 | 0.807 | | | 5 |
| 327 | PHI-4 | 220 | E | R | 1.7 | 0.414 | | | 5 |
| 328 | PHI-4 | 99 | K | F | 1.6 | 0.363 | | | 5 |
| 329 | PHI-4 | 289 | K | W | 1.6 | 0.457 | | | 5 |
| 330 | PHI-4 | 527 | Q | H | 1.6 | 0.251 | | | 5 |
| 331 | PHI-4 | 220 | E | W | 1.6 | 0.508 | | | 5 |
| 332 | PHI-4 | 9 | Q | K | 1.6 | 0.756 | | | 5 |
| 333 | PHI-4 | 99 | K | C | 1.6 | 0.454 | | | 5 |
| 334 | PHI-4 | 309 | Q | K | 1.6 | 0.737 | | | 5 |
| 335 | PHI-4 | 148 | D | W | 1.6 | 0.054 | | | 5 |
| 336 | PHI-4 | 216 | E | F | 1.6 | 0.451 | | | 5 |
| 337 | PHI-4 | 99 | K | V | 1.6 | 0.487 | | | 5 |
| 338 | PHI-4 | 454 | R | H | 1.6 | 0.577 | | | 5 |
| 339 | PHI-4 | 309 | Q | E | 1.5 | 0.704 | | | 5 |
| 340 | PHI-4 | 165 | K | T | 1.5 | 0.519 | | | 5 |
| 341 | PHI-4 | 165 | K | A | 1.5 | 0.529 | | | 5 |
| 342 | PHI-4 | 398 | S | Q | 1.5 | 0.523 | | | 5 |
| 343 | PHI-4 | 454 | R | D | 1.5 | 0.628 | | | 5 |
| 344 | PHI-4 | 142 | R | E | 1.5 | 0.934 | | | 5 |
| 345 | PHI-4 | 449 | Q | E | 1.5 | 0.713 | | | 5 |
| 346 | PHI-4 | 196 | Q | I | 1.5 | 0.425 | | | 5 |
| 347 | PHI-4 | 278 | E | Q | 1.5 | 0.065 | | | 5 |
| 348 | PHI-4 | 502 | R | E | 1.5 | 0.962 | | | 5 |
| 349 | PHI-4 | 165 | K | L | 1.5 | 0.602 | | | 5 |
| 350 | PHI-4 | 90 | Q | E | 1.5 | 0.721 | | | 5 |
| 351 | PHI-4 | 399 | G | A | 1.5 | 0.587 | | | 5 |
| 352 | PHI-4 | 447 | D | G | 1.5 | 0.157 | | 0.12 | 5 |
| 353 | PHI-4 | 151 | D | C | 1.5 | 0.485 | | | 5 |
| 354 | PHI-4 | 289 | K | I | 1.5 | 0.636 | | | 5 |
| 355 | PHI-4 | 459 | K | C | 1.5 | 0.73 | | | 5 |
| 356 | PHI-4 | 220 | E | M | 1.4 | 0.611 | | | 5 |
| 357 | PHI-4 | 454 | R | L | 1.4 | 0.721 | | | 5 |
| 358 | PHI-4 | 459 | K | Y | 1.4 | 0.736 | | | 5 |
| 359 | PHI-4 | 442 | Q | K | 1.4 | 0.751 | | | 5 |
| 360 | PHI-4 | 99 | K | N | 1.4 | 0.687 | | | 5 |
| 361 | PHI-4 | 402 | K | W | 1.4 | 0.758 | | | 5 |
| 362 | PHI-4 | 216 | E | V | 1.4 | 0.658 | | | 5 |
| 363 | PHI-4 | 165 | K | G | 1.4 | 0.731 | | | 5 |
| 364 | PHI-4 | 214 | K | Q | 1.4 | 0.701 | | | 5 |
| 365 | PHI-4 | 165 | K | D | 1.4 | 0.741 | | | 5 |
| 366 | PHI-4 | 165 | K | V | 1.4 | 0.744 | | | 5 |
| 367 | PHI-4 | 220 | E | A | 1.4 | 0.694 | | | 5 |
| 368 | PHI-4 | 289 | K | H | 1.4 | 0.774 | | | 5 |
| 369 | PHI-4 | 165 | K | H | 1.4 | 0.785 | | | 5 |
| 370 | PHI-4 | 82 | E | Q | 1.4 | 0.875 | | −0.77 | 5 |
| 371 | PHI-4 | 109 | F | C | 1.4 | 0.764 | | | 5 |
| 372 | PHI-4 | 220 | E | F | 1.4 | 0.726 | | | 5 |
| 373 | PHI-4 | 51 | E | Q | 1.4 | 0.853 | | | 5 |
| 374 | PHI-4 | 459 | K | P | 1.3 | 0.888 | | | 5 |
| 375 | PHI-4 | 447 | D | P | 1.3 | 0.328 | | | 5 |
| 376 | PHI-4 | 165 | K | I | 1.3 | 0.831 | | | 5 |
| 377 | PHI-4 | 220 | E | I | 1.3 | 0.764 | | | 5 |
| 378 | PHI-4 | 459 | K | N | 1.3 | 0.905 | | | 5 |
| 379 | PHI-4 | 454 | R | T | 1.3 | 0.926 | | | 5 |
| 380 | PHI-4 | 87 | K | Q | 1.3 | 0.688 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 381 | PHI-4 | 402 | K | G | 1.3 | 0.96 | | | 5 |
| 382 | PHI-4 | 289 | K | N | 1.3 | 0.91 | | | 5 |
| 383 | PHI-4 | 148 | D | A | 1.3 | 0.428 | | | 5 |
| 384 | PHI-4 | 216 | E | Y | 1.3 | 0.857 | | | 5 |
| 385 | PHI-4 | 306 | Q | K | 1.3 | 0.669 | | | 5 |
| 386 | PHI-4 | 148 | D | R | 1.3 | 0.572 | | | 5 |
| 387 | PHI-4 | 151 | D | M | 1.3 | 0.852 | | | 5 |
| 388 | PHI-4 | 257 | Q | C | 1.3 | 0.848 | | | 5 |
| 389 | PHI-4 | 9 | Q | E | 1.3 | 0.687 | | | 5 |
| 390 | PHI-4 | 402 | K | N | 1.2 | 0.927 | | | 5 |
| 391 | PHI-4 | 148 | D | L | 1.2 | 0.614 | | | 5 |
| 392 | PHI-4 | 148 | D | S | 1.2 | 0.628 | | | 5 |
| 393 | PHI-4 | 436 | D | K | 1.2 | 0.755 | | | 5 |
| 394 | PHI-4 | 459 | K | A | 1.2 | 0.886 | | | 5 |
| 395 | PHI-4 | 447 | D | L | 1.2 | 0.673 | | | 5 |
| 396 | PHI-4 | 454 | R | P | 1.2 | 0.981 | | | 5 |
| 397 | PHI-4 | 398 | S | C | 1.2 | 0.984 | | | 5 |
| 398 | PHI-4 | 76 | D | Q | 1.2 | 0.755 | | | 5 |
| 399 | PHI-4 | 220 | E | L | 1.2 | 0.994 | | | 5 |
| 400 | PHI-4 | 165 | K | M | 1.2 | 0.903 | | | 5 |
| 401 | PHI-4 | 196 | Q | R | 1.2 | 0.819 | | | 5 |
| 402 | PHI-4 | 402 | K | L | 1.2 | 0.848 | | | 5 |
| 403 | PHI-4 | 220 | E | C | 1.2 | 0.994 | | | 5 |
| 404 | PHI-4 | 403 | D | E | 1.2 | 0.986 | | | 5 |
| 405 | PHI-4 | 220 | E | N | 1.2 | 0.836 | | | 5 |
| 406 | PHI-4 | 42 | D | Q | 1.2 | 0.754 | | | 5 |
| 407 | PHI-4 | 165 | K | W | 1.2 | 0.873 | | | 5 |
| 408 | PHI-4 | 466 | D | R | 1.2 | 0.795 | | | 5 |
| 409 | PHI-4 | 517 | Q | C | 1.2 | 0.789 | | | 5 |
| 410 | PHI-4 | 256 | Q | E | 1.2 | 0.618 | | | 5 |
| 411 | PHI-4 | 517 | Q | N | 1.2 | 0.785 | | | 5 |
| 412 | PHI-4 | 148 | D | Q | 1.2 | 0.754 | | | 5 |
| 413 | PHI-4 | 517 | Q | V | 1.2 | 0.777 | | | 5 |
| 414 | PHI-4 | 83 | E | Q | 1.2 | 0.668 | | | 5 |
| 415 | PHI-4 | 165 | K | F | 1.2 | 0.836 | | | 5 |
| 416 | PHI-4 | 447 | D | F | 1.2 | 0.912 | | | 5 |
| 417 | PHI-4 | 109 | F | A | 1.2 | 0.71 | | | 5 |
| 418 | PHI-4 | 86 | E | Q | 1.2 | 0.565 | | | 5 |
| 419 | PHI-4 | 61 | R | E | 1.2 | 0.567 | | | 5 |
| 420 | PHI-4 | 151 | D | L | 1.2 | 0.891 | | | 5 |
| 421 | PHI-4 | 305 | K | Q | 1.1 | 0.553 | | | 5 |
| 422 | PHI-4 | 257 | Q | S | 1.1 | 0.729 | | | 5 |
| 423 | PHI-4 | 74 | K | R | 1.1 | 0.782 | | | 5 |
| 424 | PHI-4 | 257 | Q | H | 1.1 | 0.731 | | | 5 |
| 425 | PHI-4 | 447 | D | W | 1.1 | 0.933 | | | 5 |
| 426 | PHI-4 | 402 | K | Y | 1.1 | 0.74 | | | 5 |
| 427 | PHI-4 | 257 | Q | W | 1.1 | 0.72 | | | 5 |
| 428 | PHI-4 | 517 | Q | P | 1.1 | 0.831 | | | 5 |
| 429 | PHI-4 | 331 | E | Q | 1.1 | 0.661 | | | 5 |
| 430 | PHI-4 | 334 | G | W | 1.1 | 0.635 | | | 5 |
| 431 | PHI-4 | 335 | S | A | 1.1 | 0.754 | | | 5 |
| 432 | PHI-4 | 297 | E | Q | 1.1 | 0.497 | | | 5 |
| 433 | PHI-4 | 264 | E | Q | 1.1 | 0.658 | | | 5 |
| 434 | PHI-4 | 447 | D | T | 1.1 | 0.767 | | | 5 |
| 435 | PHI-4 | 229 | R | E | 1.1 | 0.494 | | | 5 |
| 436 | PHI-4 | 298 | D | Q | 1.1 | 0.752 | | | 5 |
| 437 | PHI-4 | 527 | Q | F | 1.1 | 0.763 | | | 5 |
| 438 | PHI-4 | 74 | K | M | 1.1 | 0.695 | | | 5 |
| 439 | PHI-4 | 289 | K | C | 1.1 | 0.677 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 440 | PHI-4 | 113 | D | E | 1.1 | 0.877 | | | 5 |
| 441 | PHI-4 | 257 | Q | M | 1.1 | 0.651 | | | 5 |
| 442 | PHI-4 | 207 | K | Q | 1.1 | 0.463 | | | 5 |
| 443 | PHI-4 | 454 | R | N | 1.1 | 0.624 | | | 5 |
| 444 | PHI-4 | 502 | R | Q | 1.1 | 0.454 | | | 5 |
| 445 | PHI-4 | 402 | K | T | 1.1 | 0.62 | | | 5 |
| 446 | PHI-4 | 151 | D | R | 1.1 | 0.692 | | | 5 |
| 447 | PHI-4 | 527 | Q | W | 1.1 | 0.616 | | | 5 |
| 448 | PHI-4 | 109 | F | R | 1 | 0.682 | | | 5 |
| 449 | PHI-4 | 151 | D | E | 1 | 0.655 | | | 5 |
| 450 | PHI-4 | 289 | K | G | 1 | 0.617 | | | 5 |
| 451 | PHI-4 | 74 | K | L | 1 | 0.611 | | | 5 |
| 452 | PHI-4 | 146 | R | Q | 1 | 0.424 | | | 5 |
| 453 | PHI-4 | 113 | D | M | 1 | 0.736 | | | 5 |
| 454 | PHI-4 | 74 | K | H | 1 | 0.636 | | | 5 |
| 455 | PHI-4 | 191 | K | Q | 1 | 0.649 | | | 5 |
| 456 | PHI-4 | 291 | E | Q | 1 | 0.424 | | | 5 |
| 457 | PHI-4 | 148 | D | G | 1 | 0.724 | | | 5 |
| 458 | PHI-4 | 165 | K | Y | 1 | 0.595 | | | 5 |
| 459 | PHI-4 | 74 | K | D | 1 | 0.582 | | | 5 |
| 460 | PHI-4 | 402 | K | V | 1 | 0.556 | | | 5 |
| 461 | PHI-4 | 165 | K | R | 1 | 0.575 | | | 5 |
| 462 | PHI-4 | 497 | D | Q | 1 | 0.75 | | | 5 |
| 463 | PHI-4 | 397 | G | A | 1 | 0.568 | | | 5 |
| 464 | PHI-4 | 289 | K | A | 1 | 0.558 | | | 5 |
| 465 | PHI-4 | 517 | Q | E | 1 | 0.509 | | | 5 |
| 466 | PHI-4 | 360 | Q | E | 1 | 0.523 | | | 5 |
| 467 | PHI-4 | 254 | D | K | 1 | 0.75 | | | 5 |
| 468 | PHI-4 | 402 | K | S | 1 | 0.511 | | | 5 |
| 469 | PHI-4 | 288 | D | Q | 1 | 0.75 | | | 5 |
| 470 | PHI-4 | 454 | R | C | 1 | 0.51 | | | 5 |
| 471 | PHI-4 | 306 | Q | E | 1 | 0.547 | | | 5 |
| 472 | PHI-4 | 82 | E | V | 1 | 0.626 | | | 5 |
| 473 | PHI-4 | 113 | D | N | 1 | 0.538 | | | 5 |
| 474 | PHI-4 | 447 | D | M | 1 | 0.498 | | | 5 |
| 475 | PHI-4 | 447 | D | H | 1 | 0.497 | | | 5 |
| 476 | PHI-4 | 151 | D | G | 1 | 0.494 | | | 5 |
| 477 | PHI-4 | 214 | K | E | 1 | 0.339 | | | 5 |
| 478 | PHI-4 | 148 | D | C | 1 | 0.506 | | | 5 |
| 479 | PHI-4 | 216 | E | T | 1 | 0.601 | | | 5 |
| 480 | PHI-4 | 87 | K | E | 0.9 | 0.329 | | | 5 |
| 481 | PHI-4 | 165 | K | N | 0.9 | 0.467 | | | 5 |
| 482 | PHI-4 | 151 | D | K | 0.9 | 0.749 | | | 5 |
| 483 | PHI-4 | 113 | D | S | 0.9 | 0.441 | | | 5 |
| 484 | PHI-4 | 402 | K | D | 0.9 | 0.415 | | | 5 |
| 485 | PHI-4 | 459 | K | R | 0.9 | 0.42 | | 0.24 | 5 |
| 486 | PHI-4 | 74 | K | F | 0.9 | 0.427 | | | 5 |
| 487 | PHI-4 | 361 | R | E | 0.9 | 0.304 | | | 5 |
| 488 | PHI-4 | 165 | K | C | 0.9 | 0.421 | | | 5 |
| 489 | PHI-4 | 72 | D | Q | 0.9 | 0.748 | | | 5 |
| 490 | PHI-4 | 257 | Q | V | 0.9 | 0.441 | | | 5 |
| 491 | PHI-4 | 220 | E | K | 0.9 | 0.535 | | | 5 |
| 492 | PHI-4 | 334 | G | H | 0.9 | 0.575 | | | 5 |
| 493 | PHI-4 | 113 | D | H | 0.9 | 0.394 | | | 5 |
| 494 | PHI-4 | 517 | Q | R | 0.9 | 0.421 | | | 5 |
| 495 | PHI-4 | 436 | D | Q | 0.9 | 0.748 | | | 5 |
| 496 | PHI-4 | 235 | R | P | 0.9 | 0.396 | | | 5 |
| 497 | PHI-4 | 235 | R | K | 0.9 | 0.748 | | −0.01 | 5 |
| 498 | PHI-4 | 79 | K | Q | 0.9 | 0.277 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 499 | PHI-4 | 527 | Q | Y | 0.9 | 0.414 | | | 5 |
| 500 | PHI-4 | 113 | D | A | 0.9 | 0.326 | | | 5 |
| 501 | PHI-4 | 216 | E | S | 0.9 | 0.501 | | | 5 |
| 502 | PHI-4 | 257 | Q | L | 0.9 | 0.409 | | | 5 |
| 503 | PHI-4 | 46 | E | Q | 0.9 | 0.627 | | | 5 |
| 504 | PHI-4 | 447 | D | N | 0.9 | 0.369 | | | 5 |
| 505 | PHI-4 | 247 | D | E | 0.9 | 0.321 | | | 5 |
| 506 | PHI-4 | 72 | D | K | 0.9 | 0.748 | | | 5 |
| 507 | PHI-4 | 517 | Q | H | 0.9 | 0.404 | | | 5 |
| 508 | PHI-4 | 74 | K | W | 0.9 | 0.361 | | | 5 |
| 509 | PHI-4 | 442 | Q | E | 0.9 | 0.48 | | 0.3 | 5 |
| 510 | PHI-4 | 229 | R | Q | 0.9 | 0.258 | | | 5 |
| 511 | PHI-4 | 527 | Q | R | 0.9 | 0.388 | | | 5 |
| 512 | PHI-4 | 74 | K | V | 0.9 | 0.367 | | | 5 |
| 513 | PHI-4 | 288 | D | K | 0.9 | 0.747 | | | 5 |
| 514 | PHI-4 | 48 | D | Q | 0.9 | 0.747 | | | 5 |
| 515 | PHI-4 | 517 | Q | S | 0.9 | 0.378 | | | 5 |
| 516 | PHI-4 | 402 | K | A | 0.9 | 0.333 | | | 5 |
| 517 | PHI-4 | 216 | E | A | 0.8 | 0.452 | | | 5 |
| 518 | PHI-4 | 216 | E | G | 0.8 | 0.45 | | | 5 |
| 519 | PHI-4 | 113 | D | Y | 0.8 | 0.302 | | | 5 |
| 520 | PHI-4 | 402 | K | M | 0.8 | 0.313 | | | 5 |
| 521 | PHI-4 | 82 | E | P | 0.8 | 0.63 | | | 5 |
| 522 | PHI-4 | 525 | Q | E | 0.8 | 0.469 | | | 5 |
| 523 | PHI-4 | 99 | K | R | 0.8 | 0.312 | | | 5 |
| 524 | PHI-4 | 257 | Q | G | 0.8 | 0.35 | | | 5 |
| 525 | PHI-4 | 48 | D | K | 0.8 | 0.746 | | | 5 |
| 526 | PHI-4 | 305 | K | E | 0.8 | 0.226 | | | 5 |
| 527 | PHI-4 | 216 | E | W | 0.8 | 0.417 | | | 5 |
| 528 | PHI-4 | 207 | K | E | 0.8 | 0.22 | | | 5 |
| 529 | PHI-4 | 447 | D | V | 0.8 | 0.266 | | | 5 |
| 530 | PHI-4 | 196 | Q | F | 0.8 | 0.337 | | | 5 |
| 531 | PHI-4 | 216 | E | K | 0.8 | 0.406 | | | 5 |
| 532 | PHI-4 | 151 | D | H | 0.8 | 0.263 | | | 5 |
| 533 | PHI-4 | 74 | K | S | 0.8 | 0.285 | | | 5 |
| 534 | PHI-4 | 90 | Q | K | 0.8 | 0.466 | | | 5 |
| 535 | PHI-4 | 459 | K | G | 0.8 | 0.282 | | | 5 |
| 536 | PHI-4 | 454 | R | E | 0.8 | 0.215 | | | 5 |
| 537 | PHI-4 | 216 | E | R | 0.8 | 0.391 | | 0.04 | 5 |
| 538 | PHI-4 | 74 | K | Y | 0.8 | 0.276 | | | 5 |
| 539 | PHI-4 | 99 | K | S | 0.8 | 0.277 | | | 5 |
| 540 | PHI-4 | 248 | R | Q | 0.8 | 0.201 | | | 5 |
| 541 | PHI-4 | 142 | R | Q | 0.8 | 0.193 | | | 5 |
| 542 | PHI-4 | 82 | E | F | 0.8 | 0.615 | | | 5 |
| 543 | PHI-4 | 461 | T | A | 0.8 | 0.245 | | | 5 |
| 544 | PHI-4 | 33 | E | Q | 0.8 | 0.185 | | | 5 |
| 545 | PHI-4 | 193 | D | Q | 0.8 | 0.745 | | | 5 |
| 546 | PHI-4 | 332 | D | N | 0.8 | 0.226 | | | 5 |
| 547 | PHI-4 | 42 | D | K | 0.8 | 0.745 | | | 5 |
| 548 | PHI-4 | 74 | K | A | 0.8 | 0.238 | | | 5 |
| 549 | PHI-4 | 257 | Q | K | 0.7 | 0.461 | | | 5 |
| 550 | PHI-4 | 148 | D | M | 0.7 | 0.117 | | | 5 |
| 551 | PHI-4 | 527 | Q | G | 0.7 | 0.272 | | | 5 |
| 552 | PHI-4 | 527 | Q | V | 0.7 | 0.276 | | | 5 |
| 553 | PHI-4 | 379 | D | Q | 0.7 | 0.745 | | | 5 |
| 554 | PHI-4 | 146 | R | E | 0.7 | 0.607 | | | 5 |
| 555 | PHI-4 | 527 | Q | T | 0.7 | 0.266 | | | 5 |
| 556 | PHI-4 | 454 | R | A | 0.7 | 0.213 | | | 5 |
| 557 | PHI-4 | 216 | E | D | 0.7 | 0.306 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Back-bone | Position | Ref A.A. | Substitution | FAE | P-value | EC50 (ppm) | Deviation | Example # |
|---|---|---|---|---|---|---|---|---|---|
| 558 | PHI-4 | 402 | K | C | 0.7 | 0.203 | | | 5 |
| 559 | PHI-4 | 517 | Q | T | 0.7 | 0.256 | | | 5 |
| 560 | PHI-4 | 257 | Q | P | 0.7 | 0.256 | | | 5 |
| 561 | PHI-4 | 220 | E | G | 0.7 | 0.3 | | | 5 |
| 562 | PHI-4 | 99 | K | H | 0.7 | 0.2 | | | 5 |
| 563 | PHI-4 | 55 | R | E | 0.7 | 0.153 | | | 5 |
| 564 | PHI-4 | 340 | D | N | 0.7 | 0.179 | | | 5 |
| 565 | PHI-4 | 466 | D | N | 0.7 | 0.185 | | | 5 |
| 566 | PHI-4 | 257 | Q | A | 0.7 | 0.238 | | | 5 |
| 567 | PHI-4 | 99 | K | T | 0.7 | 0.191 | | | 5 |
| 568 | PHI-4 | 74 | K | T | 0.7 | 0.189 | | | 5 |
| 569 | PHI-4 | 113 | D | L | 0.7 | 0.081 | | | 5 |
| 570 | PHI-4 | 74 | K | Q | 0.7 | 0.602 | | | 5 |
| 571 | PHI-4 | 527 | Q | I | 0.7 | 0.238 | | | 5 |
| 572 | PHI-4 | 99 | K | A | 0.7 | 0.186 | | | 5 |
| 573 | PHI-4 | 517 | Q | W | 0.7 | 0.235 | | | 5 |
| 574 | PHI-4 | 126 | E | Q | 0.7 | 0.459 | | −0.15 | 5 |
| 575 | PHI-4 | 196 | Q | G | 0.7 | 0.231 | | | 5 |
| 576 | PHI-4 | 274 | D | K | 0.7 | 0.744 | | | 5 |
| 577 | PHI-4 | 517 | Q | G | 0.7 | 0.229 | | | 5 |
| 578 | PHI-4 | 99 | K | W | 0.7 | 0.175 | | | 5 |
| 579 | PHI-4 | 394 | D | Q | 0.7 | 0.743 | | | 5 |
| 580 | PHI-4 | 216 | E | I | 0.7 | 0.257 | | | 5 |
| 581 | PHI-4 | 517 | Q | M | 0.7 | 0.214 | | | 5 |
| 582 | PHI-4 | 334 | G | S | 0.7 | 0.507 | | | 5 |
| 583 | PHI-4 | 517 | Q | D | 0.7 | 0.207 | | | 5 |
| 584 | PHI-4 | 196 | Q | L | 0.7 | 0.21 | | | 5 |
| 585 | PHI-4 | 298 | D | K | 0.6 | 0.742 | | | 5 |
| 586 | PHI-4 | 74 | K | C | 0.6 | 0.141 | | | 5 |
| 587 | PHI-4 | 395 | D | S | 0.6 | 0.538 | | | 5 |
| 588 | PHI-4 | 74 | K | I | 0.6 | 0.139 | | | 5 |
| 589 | PHI-4 | 527 | Q | M | 0.6 | 0.189 | | | 5 |
| 590 | PHI-4 | 113 | D | Q | 0.6 | 0.742 | | | 5 |
| 591 | PHI-4 | 340 | D | A | 0.6 | 0.142 | | | 5 |
| 592 | PHI-4 | 216 | E | H | 0.6 | 0.216 | | | 5 |
| 593 | PHI-4 | 402 | K | I | 0.6 | 0.13 | | | 5 |
| 594 | PHI-4 | 235 | R | S | 0.6 | 0.123 | | | 5 |
| 595 | PHI-4 | 75 | Q | K | 0.6 | 0.422 | | | 5 |
| 596 | PHI-4 | 203 | E | Q | 0.6 | 0.588 | | −0.37 | 5 |
| 597 | PHI-4 | 527 | Q | A | 0.6 | 0.167 | | | 5 |
| 598 | PHI-4 | 517 | Q | A | 0.6 | 0.163 | | | 5 |
| 599 | PHI-4 | 361 | R | Q | 0.6 | 0.094 | | | 5 |
| 600 | PHI-4 | 466 | D | P | 0.6 | 0.075 | | | 5 |
| 601 | PHI-4 | 193 | D | K | 0.6 | 0.741 | | | 5 |
| 602 | PHI-4 | 458 | D | V | 0.6 | 0.075 | | | 5 |
| 603 | PHI-4 | 268 | D | Q | 0.6 | 0.741 | | | 5 |
| 604 | PHI-4 | 61 | R | Q | 0.6 | 0.086 | | | 5 |
| 605 | PHI-4 | 151 | D | Y | 0.6 | 0.068 | | | 5 |
| 606 | PHI-4 | 196 | Q | Y | 0.6 | 0.146 | | | 5 |
| 607 | PHI-4 | 196 | Q | V | 0.5 | 0.145 | | | 5 |
| 608 | PHI-4 | 527 | Q | D | 0.5 | 0.144 | | | 5 |
| 609 | PHI-4 | 166 | R | E | 0.5 | 0.084 | | | 5 |
| 610 | PHI-4 | 334 | G | A | 0.5 | 0.477 | | | 5 |
| 611 | PHI-4 | 447 | D | Q | 0.5 | 0.74 | | | 5 |
| 612 | PHI-4 | 196 | Q | C | 0.5 | 0.137 | | | 5 |
| 613 | PHI-4 | 466 | D | K | 0.5 | 0.74 | | | 5 |
| 614 | PHI-4 | 74 | K | P | 0.5 | 0.083 | | | 5 |
| 615 | PHI-4 | 196 | Q | M | 0.5 | 0.127 | | | 5 |
| 616 | PHI-4 | 99 | K | D | 0.5 | 0.083 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 617 | PHI-4 | 82 | E | D | 0.5 | 0.141 | | | 5 |
| 618 | PHI-4 | 216 | E | M | 0.5 | 0.136 | | | 5 |
| 619 | PHI-4 | 235 | R | H | 0.5 | 0.074 | | | 5 |
| 620 | PHI-4 | 340 | D | P | 0.5 | 0.078 | | | 5 |
| 621 | PHI-4 | 216 | E | L | 0.5 | 0.134 | | | 5 |
| 622 | PHI-4 | 458 | D | G | 0.5 | 0.119 | | | 5 |
| 623 | PHI-4 | 403 | D | S | 0.5 | 0.074 | | | 5 |
| 624 | PHI-4 | 360 | Q | K | 0.5 | 0.335 | | | 5 |
| 625 | PHI-4 | 216 | E | P | 0.5 | 0.127 | | | 5 |
| 626 | PHI-4 | 257 | Q | Y | 0.5 | 0.11 | | | 5 |
| 627 | PHI-4 | 118 | E | Q | 0.5 | 0.061 | | | 5 |
| 628 | PHI-4 | 379 | D | K | 0.5 | 0.739 | | | 5 |
| 629 | PHI-4 | 402 | K | Q | 0.5 | 0.061 | | | 5 |
| 630 | PHI-4 | 254 | D | Q | 0.5 | 0.739 | | | 5 |
| 631 | PHI-4 | 257 | Q | T | 0.5 | 0.107 | | | 5 |
| 632 | PHI-4 | 458 | D | P | 0.5 | 0.04 | | | 5 |
| 633 | PHI-4 | 466 | D | W | 0.5 | 0.036 | | | 5 |
| 634 | PHI-4 | 403 | D | L | 0.5 | 0.037 | | | 5 |
| 635 | PHI-4 | 196 | Q | H | 0.5 | 0.101 | | | 5 |
| 636 | PHI-4 | 517 | Q | L | 0.4 | 0.099 | | | 5 |
| 637 | PHI-4 | 196 | Q | S | 0.4 | 0.099 | | | 5 |
| 638 | PHI-4 | 257 | Q | F | 0.4 | 0.096 | | | 5 |
| 639 | PHI-4 | 196 | Q | T | 0.4 | 0.096 | | | 5 |
| 640 | PHI-4 | 235 | R | G | 0.4 | 0.055 | | | 5 |
| 641 | PHI-4 | 332 | D | S | 0.4 | 0.005 | | | 5 |
| 642 | PHI-4 | 152 | D | Q | 0.4 | 0.738 | | | 5 |
| 643 | PHI-4 | 368 | D | Q | 0.4 | 0.738 | | | 5 |
| 644 | PHI-4 | 257 | Q | R | 0.4 | 0.092 | | | 5 |
| 645 | PHI-4 | 315 | D | K | 0.4 | 0.738 | | | 5 |
| 646 | PHI-4 | 99 | K | P | 0.4 | 0.052 | | | 5 |
| 647 | PHI-4 | 109 | F | P | 0.4 | 0.103 | | | 5 |
| 648 | PHI-4 | 113 | D | T | 0.4 | 0.004 | | | 5 |
| 649 | PHI-4 | 334 | G | M | 0.4 | 0.447 | | | 5 |
| 650 | PHI-4 | 75 | Q | E | 0.4 | 0.315 | | | 5 |
| 651 | PHI-4 | 274 | D | Q | 0.4 | 0.738 | | | 5 |
| 652 | PHI-4 | 402 | K | E | 0.4 | 0.048 | | | 5 |
| 653 | PHI-4 | 191 | K | E | 0.4 | 0.048 | | | 5 |
| 654 | PHI-4 | 332 | D | E | 0.4 | 0.004 | | | 5 |
| 655 | PHI-4 | 517 | Q | Y | 0.4 | 0.085 | | | 5 |
| 656 | PHI-4 | 340 | D | I | 0.4 | 0.025 | | | 5 |
| 657 | PHI-4 | 459 | K | D | 0.4 | 0.05 | | | 5 |
| 658 | PHI-4 | 76 | D | K | 0.4 | 0.738 | | | 5 |
| 659 | PHI-4 | 216 | E | C | 0.4 | 0.093 | | | 5 |
| 660 | PHI-4 | 340 | D | R | 0.4 | 0.048 | | | 5 |
| 661 | PHI-4 | 466 | D | Y | 0.4 | 0.025 | | | 5 |
| 662 | PHI-4 | 340 | D | G | 0.4 | 0.046 | | | 5 |
| 663 | PHI-4 | 376 | D | Q | 0.4 | 0.737 | | | 5 |
| 664 | PHI-4 | 203 | E | C | 0.4 | 0.088 | | | 5 |
| 665 | PHI-4 | 235 | R | N | 0.4 | 0.042 | | | 5 |
| 666 | PHI-4 | 247 | D | S | 0.4 | 0.076 | | | 5 |
| 667 | PHI-4 | 332 | D | F | 0.4 | 0.021 | | | 5 |
| 668 | PHI-4 | 216 | E | N | 0.4 | 0.083 | | | 5 |
| 669 | PHI-4 | 527 | Q | N | 0.4 | 0.076 | | | 5 |
| 670 | PHI-4 | 340 | D | C | 0.4 | 0.043 | | | 5 |
| 671 | PHI-4 | 38 | Q | E | 0.4 | 0.297 | | | 5 |
| 672 | PHI-4 | 152 | D | K | 0.4 | 0.737 | | | 5 |
| 673 | PHI-4 | 413 | Q | E | 0.4 | 0.316 | | | 5 |
| 674 | PHI-4 | 247 | D | T | 0.4 | 0.002 | | | 5 |
| 675 | PHI-4 | 235 | R | V | 0.3 | 0.034 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 676 | PHI-4 | 268 | D | K | 0.3 | 0.736 | | | 5 |
| 677 | PHI-4 | 99 | K | Q | 0.3 | 0.034 | | | 5 |
| 678 | PHI-4 | 235 | R | D | 0.3 | 0.032 | | | 5 |
| 679 | PHI-4 | 394 | D | K | 0.3 | 0.736 | | | 5 |
| 680 | PHI-4 | 458 | D | C | 0.3 | 0.001 | | | 5 |
| 681 | PHI-4 | 340 | D | Y | 0.3 | 0.015 | | | 5 |
| 682 | PHI-4 | 24 | D | K | 0.3 | 0.736 | | | 5 |
| 683 | PHI-4 | 466 | D | G | 0.3 | 0.001 | | | 5 |
| 684 | PHI-4 | 466 | D | C | 0.3 | 0.014 | | | 5 |
| 685 | PHI-4 | 402 | K | P | 0.3 | 0.013 | | | 5 |
| 686 | PHI-4 | 340 | D | L | 0.3 | 0.031 | | | 5 |
| 687 | PHI-4 | 334 | G | Y | 0.3 | 0.421 | | | 5 |
| 688 | PHI-4 | 334 | G | Q | 0.3 | 0.421 | | | 5 |
| 689 | PHI-4 | 334 | G | L | 0.3 | 0.42 | | | 5 |
| 690 | PHI-4 | 398 | S | V | 0.3 | 0.013 | | | 5 |
| 691 | PHI-4 | 334 | G | N | 0.3 | 0.42 | | | 5 |
| 692 | PHI-4 | 398 | S | H | 0.3 | 0.012 | | | 5 |
| 693 | PHI-4 | 113 | D | R | 0.3 | 0.001 | | | 5 |
| 694 | PHI-4 | 235 | R | T | 0.3 | 0.026 | | | 5 |
| 695 | PHI-4 | 334 | G | C | 0.3 | 0.417 | | | 5 |
| 696 | PHI-4 | 248 | R | E | 0.3 | 0.028 | | | 5 |
| 697 | PHI-4 | 235 | R | I | 0.3 | 0.025 | | | 5 |
| 698 | PHI-4 | 398 | S | R | 0.3 | 0.011 | | | 5 |
| 699 | PHI-4 | 334 | G | F | 0.3 | 0.455 | | | 5 |
| 700 | PHI-4 | 113 | D | P | 0.3 | 0.001 | | | 5 |
| 701 | PHI-4 | 109 | F | L | 0.3 | 0.052 | | | 5 |
| 702 | PHI-4 | 203 | E | S | 0.3 | 0.412 | | | 5 |
| 703 | PHI-4 | 109 | F | Y | 0.3 | 0.412 | | | 5 |
| 704 | PHI-4 | 466 | D | E | 0.3 | 0.001 | | | 5 |
| 705 | PHI-4 | 55 | R | Q | 0.3 | 0.025 | | | 5 |
| 706 | PHI-4 | 203 | E | V | 0.3 | 0.411 | | | 5 |
| 707 | PHI-4 | 398 | S | L | 0.3 | 0.01 | | | 5 |
| 708 | PHI-4 | 332 | D | G | 0.3 | 0.001 | | | 5 |
| 709 | PHI-4 | 203 | E | G | 0.3 | 0.41 | | | 5 |
| 710 | PHI-4 | 466 | D | I | 0.3 | 0.009 | | | 5 |
| 711 | PHI-4 | 466 | D | A | 0.3 | 0 | | | 5 |
| 712 | PHI-4 | 235 | R | A | 0.3 | 0.021 | | | 5 |
| 713 | PHI-4 | 340 | D | V | 0.3 | 0.022 | | | 5 |
| 714 | PHI-4 | 466 | D | F | 0.3 | 0.009 | | | 5 |
| 715 | PHI-4 | 99 | K | E | 0.3 | 0.023 | | | 5 |
| 716 | PHI-4 | 188 | K | E | 0.3 | 0.022 | | | 5 |
| 717 | PHI-4 | 235 | R | C | 0.2 | 0.019 | | | 5 |
| 718 | PHI-4 | 235 | R | F | 0.2 | 0.018 | | | 5 |
| 719 | PHI-4 | 340 | D | W | 0.2 | 0.02 | | | 5 |
| 720 | PHI-4 | 235 | R | L | 0.2 | 0.018 | | | 5 |
| 721 | PHI-4 | 113 | D | W | 0.2 | 0 | | | 5 |
| 722 | PHI-4 | 459 | K | E | 0.2 | 0.541 | | | 5 |
| 723 | PHI-4 | 334 | G | V | 0.2 | 0.4 | | | 5 |
| 724 | PHI-4 | 113 | D | V | 0.2 | 0 | | | 5 |
| 725 | PHI-4 | 113 | D | G | 0.2 | 0 | | | 5 |
| 726 | PHI-4 | 235 | R | M | 0.2 | 0.015 | | | 5 |
| 727 | PHI-4 | 403 | D | N | 0.2 | 0.012 | | | 5 |
| 728 | PHI-4 | 203 | E | N | 0.2 | 0.396 | | | 5 |
| 729 | PHI-4 | 340 | D | F | 0.2 | 0.006 | | | 5 |
| 730 | PHI-4 | 340 | D | S | 0.2 | 0.005 | | | 5 |
| 731 | PHI-4 | 247 | D | P | 0.2 | 0 | | | 5 |
| 732 | PHI-4 | 203 | E | I | 0.2 | 0.035 | | | 5 |
| 733 | PHI-4 | 148 | D | K | 0.2 | 0.733 | | | 5 |
| 734 | PHI-4 | 466 | D | T | 0.2 | 0 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 735 | PHI-4 | 332 | D | H | 0.2 | 0.005 | | | 5 |
| 736 | PHI-4 | 458 | D | A | 0.2 | 0 | | | 5 |
| 737 | PHI-4 | 235 | R | E | 0.2 | 0.016 | | | 5 |
| 738 | PHI-4 | 340 | D | K | 0.2 | 0.733 | | | 5 |
| 739 | PHI-4 | 466 | D | V | 0.2 | 0 | | | 5 |
| 740 | PHI-4 | 109 | F | V | 0.2 | 0.032 | | | 5 |
| 741 | PHI-4 | 398 | S | T | 0.2 | 0.389 | | | 5 |
| 742 | PHI-4 | 99 | K | G | 0.2 | 0.012 | | | 5 |
| 743 | PHI-4 | 466 | D | L | 0.2 | 0 | | | 5 |
| 744 | PHI-4 | 340 | D | T | 0.2 | 0.013 | | | 5 |
| 745 | PHI-4 | 332 | D | A | 0.2 | 0 | | | 5 |
| 746 | PHI-4 | 403 | D | R | 0.2 | 0.013 | | | 5 |
| 747 | PHI-4 | 113 | D | K | 0.2 | 0.733 | | | 5 |
| 748 | PHI-4 | 403 | D | A | 0.2 | 0.013 | | | 5 |
| 749 | PHI-4 | 109 | F | Q | 0.2 | 0.03 | | | 5 |
| 750 | PHI-4 | 332 | D | C | 0.2 | 0 | | | 5 |
| 751 | PHI-4 | 340 | D | M | 0.2 | 0.004 | | | 5 |
| 752 | PHI-4 | 203 | E | R | 0.2 | 0.029 | | | 5 |
| 753 | PHI-4 | 235 | R | Y | 0.2 | 0.011 | | | 5 |
| 754 | PHI-4 | 196 | Q | P | 0.2 | 0.029 | | | 5 |
| 755 | PHI-4 | 247 | D | W | 0.2 | 0 | | | 5 |
| 756 | PHI-4 | 203 | E | A | 0.2 | 0.384 | | | 5 |
| 757 | PHI-4 | 466 | D | H | 0.2 | 0 | | | 5 |
| 758 | PHI-4 | 203 | E | F | 0.1 | 0.027 | | | 5 |
| 759 | PHI-4 | 449 | Q | K | 0.1 | 0.206 | | | 5 |
| 760 | PHI-4 | 334 | G | T | 0.1 | 0.382 | | | 5 |
| 761 | PHI-4 | 413 | Q | K | 0.1 | 0.223 | | | 5 |
| 762 | PHI-4 | 38 | Q | K | 0.1 | 0.242 | | | 5 |
| 763 | PHI-4 | 82 | E | R | 0.1 | 0.381 | | | 5 |
| 764 | PHI-4 | 340 | D | H | 0.1 | 0.003 | | | 5 |
| 765 | PHI-4 | 235 | R | W | 0.1 | 0.009 | | | 5 |
| 766 | PHI-4 | 398 | S | P | 0.1 | 0.026 | | | 5 |
| 767 | PHI-4 | 458 | D | S | 0.1 | 0 | | −0.49 | 5 |
| 768 | PHI-4 | 247 | D | N | 0.1 | 0 | | | 5 |
| 769 | PHI-4 | 466 | D | S | 0.1 | 0 | | | 5 |
| 770 | PHI-4 | 395 | D | I | 0.1 | 0.379 | | | 5 |
| 771 | PHI-4 | 466 | D | Q | 0.1 | 0.732 | | | 5 |
| 772 | PHI-4 | 220 | E | P | 0.1 | 0.01 | | | 5 |
| 773 | PHI-4 | 340 | D | Q | 0.1 | 0.732 | | | 5 |
| 774 | PHI-4 | 247 | D | G | 0.1 | 0 | | | 5 |
| 775 | PHI-4 | 203 | E | Y | 0.1 | 0.025 | | | 5 |
| 776 | PHI-4 | 334 | G | E | 0.1 | 0.378 | | | 5 |
| 777 | PHI-4 | 247 | D | A | 0.1 | 0.025 | | | 5 |
| 778 | PHI-4 | 458 | D | F | 0.1 | 0.003 | | | 5 |
| 779 | PHI-4 | 403 | D | C | 0.1 | 0 | | | 5 |
| 780 | PHI-4 | 403 | D | I | 0.1 | 0.003 | | | 5 |
| 781 | PHI-4 | 403 | D | V | 0.1 | 0.009 | | | 5 |
| 782 | PHI-4 | 403 | D | G | 0.1 | 0.009 | | | 5 |
| 783 | PHI-4 | 203 | E | K | 0.1 | 0.373 | | | 5 |
| 784 | PHI-4 | 398 | S | A | 0.1 | 0.372 | | | 5 |
| 785 | PHI-4 | 340 | D | E | 0.1 | 0.008 | | | 5 |
| 786 | PHI-4 | 82 | E | H | 0.1 | 0.371 | | | 5 |
| 787 | PHI-4 | 203 | E | W | 0.1 | 0.37 | | | 5 |
| 788 | PHI-4 | 447 | D | R | 0.1 | 0 | | | 5 |
| 789 | PHI-4 | 109 | F | W | 0.1 | 0.37 | | | 5 |
| 790 | PHI-4 | 247 | D | V | 0.1 | 0 | | | 5 |
| 791 | PHI-4 | 203 | E | L | 0.1 | 0.369 | | | 5 |
| 792 | PHI-4 | 332 | D | T | 0.1 | 0 | | | 5 |
| 793 | PHI-4 | 332 | D | I | 0.1 | 0.002 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 794 | PHI-4 | 82 | E | G | 0.1 | 0.019 | | | 5 |
| 795 | PHI-4 | 247 | D | L | 0.1 | 0 | | | 5 |
| 796 | PHI-4 | 368 | D | K | 0.1 | 0.731 | | | 5 |
| 797 | PHI-4 | 82 | E | M | 0.1 | 0.018 | | | 5 |
| 798 | PHI-4 | 247 | D | H | 0.1 | 0 | | | 5 |
| 799 | PHI-4 | 458 | D | N | 0.1 | 0.019 | | | 5 |
| 800 | PHI-4 | 235 | R | Q | 0.1 | 0.008 | | | 5 |
| 801 | PHI-4 | 398 | S | D | 0.1 | 0.017 | | | 5 |
| 802 | PHI-4 | 332 | D | Y | 0.1 | 0 | | | 5 |
| 803 | PHI-4 | 247 | D | F | 0.1 | 0.018 | | | 5 |
| 804 | PHI-4 | 332 | D | V | 0.1 | 0 | | | 5 |
| 805 | PHI-4 | 395 | D | A | 0.1 | 0.017 | | | 5 |
| 806 | PHI-4 | 334 | G | P | 0.1 | 0.362 | | | 5 |
| 807 | PHI-4 | 53 | E | Q | 0.1 | 0.008 | | | 5 |
| 808 | PHI-4 | 97 | R | T | 0.1 | 0.016 | | | 5 |
| 809 | PHI-4 | 458 | D | I | 0.1 | 0 | | | 5 |
| 810 | PHI-4 | 398 | S | N | 0.1 | 0.016 | | | 5 |
| 811 | PHI-4 | 109 | F | H | 0.1 | 0.361 | | | 5 |
| 812 | PHI-4 | 403 | D | P | 0 | 0 | | | 5 |
| 813 | PHI-4 | 497 | D | K | 0 | 0.73 | | | 5 |
| 814 | PHI-4 | 458 | D | M | 0 | 0.017 | | | 5 |
| 815 | PHI-4 | 458 | D | T | 0 | 0.017 | | | 5 |
| 816 | PHI-4 | 447 | D | A | 0 | 0 | | | 5 |
| 817 | PHI-4 | 395 | D | N | 0 | 0.404 | 180 | −0.91 | 5 |
| 818 | PHI-4 | 247 | D | R | 0 | 0 | | | 5 |
| 819 | PHI-4 | 82 | E | T | 0 | 0.36 | | | 5 |
| 820 | PHI-4 | 395 | D | Y | 0 | 0.36 | | | 5 |
| 821 | PHI-4 | 398 | S | E | 0 | 0.36 | | | 5 |
| 822 | PHI-4 | 332 | D | Q | 0 | 0.73 | | | 5 |
| 823 | PHI-4 | 403 | D | M | 0 | 0 | | | 5 |
| 824 | PHI-4 | 247 | D | Q | 0 | 0.73 | | | 5 |
| 825 | PHI-4 | 398 | S | I | 0 | 0.015 | | | 5 |
| 826 | PHI-4 | 458 | D | Y | 0 | 0.016 | | | 5 |
| 827 | PHI-4 | 398 | S | M | 0 | 0.015 | | | 5 |
| 828 | PHI-4 | 403 | D | H | 0 | 0 | | | 5 |
| 829 | PHI-4 | 82 | E | N | 0 | 0.358 | | | 5 |
| 830 | PHI-4 | 403 | D | T | 0 | 0 | | | 5 |
| 831 | PHI-4 | 247 | D | M | 0 | 0.016 | | | 5 |
| 832 | PHI-4 | 395 | D | R | 0 | 0.015 | | | 5 |
| 833 | PHI-4 | 398 | S | Y | 0 | 0.401 | | | 5 |
| 834 | PHI-4 | 395 | D | F | 0 | 0.357 | | | 5 |
| 835 | PHI-4 | 395 | D | M | 0 | 0.357 | | | 5 |
| 836 | PHI-4 | 395 | D | P | 0 | 0.357 | | | 5 |
| 837 | PHI-4 | 97 | R | A | 0 | 0.014 | | | 5 |
| 838 | PHI-4 | 395 | D | Q | 0 | 0.73 | | −0.82 | 5 |
| 839 | PHI-4 | 332 | D | L | 0 | 0 | | | 5 |
| 840 | PHI-4 | 395 | D | W | 0 | 0.357 | | | 5 |
| 841 | PHI-4 | 332 | D | P | 0 | 0 | | | 5 |
| 842 | PHI-4 | 403 | D | Q | 0 | 0.73 | | | 5 |
| 843 | PHI-4 | 458 | D | L | 0 | 0 | | | 5 |
| 844 | PHI-4 | 398 | S | K | 0 | 0.356 | | | 5 |
| 845 | PHI-4 | 458 | D | E | 0 | 0.015 | | | 5 |
| 846 | PHI-4 | 203 | E | P | 0 | 0.014 | | | 5 |
| 847 | PHI-4 | 395 | D | T | 0 | 0.356 | | | 5 |
| 848 | PHI-4 | 82 | E | C | 0 | 0.356 | | | 5 |
| 849 | PHI-4 | 395 | D | G | 0 | 0.355 | | | 5 |
| 850 | PHI-4 | 97 | R | V | 0 | 0.014 | | | 5 |
| 851 | PHI-4 | 332 | D | W | 0 | 0 | | | 5 |
| 852 | PHI-4 | 395 | D | L | 0 | 0.355 | | | 5 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 853 | PHI-4 | 332 | D | M | 0 | 0 | | | 5 |
| 854 | PHI-4 | 398 | S | W | 0 | 0.014 | | | 5 |
| 855 | PHI-4 | 395 | D | E | 0 | 0.355 | | | 5 |
| 856 | PHI-4 | 458 | D | R | 0 | 0.015 | | | 5 |
| 857 | PHI-4 | 321 | D | K | 0 | 0.729 | | | 5 |
| 858 | PHI-4 | 82 | E | K | 0 | 0.013 | | | 5 |
| 859 | PHI-4 | 82 | E | A | 0 | 0.353 | | | 5 |
| 860 | PHI-4 | 332 | D | R | 0 | 0 | | | 5 |
| 861 | PHI-4 | 458 | D | H | 0 | 0 | | | 5 |
| 862 | PHI-4 | 398 | S | F | 0 | 0.353 | | | 5 |
| 863 | PHI-4 | 395 | D | K | 0 | 0.729 | | | 5 |
| 864 | PHI-4 | 395 | D | H | 0 | 0.353 | | | 5 |
| 865 | PHI-4 | 203 | E | M | 0 | 0.353 | | | 5 |
| 866 | PHI-4 | 458 | D | W | 0 | 0.014 | | | 5 |
| 867 | PHI-4 | 403 | D | K | 0 | 0.729 | | | 5 |
| 868 | PHI-4 | 247 | D | K | 0 | 0.729 | | | 5 |
| 869 | PHI-4 | 376 | D | K | 0 | 0.729 | | | 5 |
| 870 | PHI-4 | 321 | D | Q | 0 | 0.729 | | | 5 |
| 871 | PHI-4 | 332 | D | K | 0 | 0.729 | | | 5 |
| 872 | PHI-4 | 315 | D | Q | | | | | 5 |
| 873 | SFR16 | 293 | R | E | 19.5 | 0.045 | | | 6 |
| 874 | SFR16 | 416 | R | E | 18 | 0.039 | | | 6 |
| 875 | SFR16 | 328 | K | E | 17.8 | 0.06 | | | 6 |
| 876 | SFR16 | 500 | R | Q | 17.1 | 0.061 | | | 6 |
| 877 | SFR16 | 452 | Q | K | 8.8 | 0.014 | | | 6 |
| 878 | SFR16 | 293 | R | Q | 6.9 | 0 | | | 6 |
| 879 | SFR16 | 150 | R | Q | 4.2 | 0 | | | 6 |
| 880 | SFR16 | 471 | Q | K | 4 | 0.14 | | | 6 |
| 881 | SFR16 | 261 | Q | E | 3.1 | 0.011 | | | 6 |
| 882 | SFR16 | 520 | K | Q | 3.1 | 0.006 | | | 6 |
| 883 | SFR16 | 471 | Q | E | 3.1 | 0.01 | | | 6 |
| 884 | SFR16 | 147 | R | E | 2.7 | 0.038 | | | 6 |
| 885 | SFR16 | 520 | K | E | 2.6 | 0.888 | | | 6 |
| 886 | SFR16 | 509 | K | Q | 2.5 | 0.053 | | | 6 |
| 887 | SFR16 | 162 | E | Q | 2.5 | 0.058 | | | 6 |
| 888 | SFR16 | 281 | Q | K | 2.4 | 0.415 | | | 6 |
| 889 | SFR16 | 452 | Q | E | 2.4 | 0.13 | | | 6 |
| 890 | SFR16 | 313 | K | Q | 2.3 | 0.204 | | | 6 |
| 891 | SFR16 | 328 | K | Q | 2.2 | 0.194 | | | 6 |
| 892 | SFR16 | 391 | R | E | 2.1 | 0.812 | | | 6 |
| 893 | SFR16 | 281 | Q | E | 2.1 | 0.535 | | | 6 |
| 894 | SFR16 | 391 | R | Q | 2.1 | 0.253 | | | 6 |
| 895 | SFR16 | 174 | E | Q | 2 | 0.138 | | | 6 |
| 896 | SFR16 | 391 | R | D | 1.8 | 0.768 | | | 6 |
| 897 | SFR16 | 147 | R | Q | 1.5 | 0.712 | | | 6 |
| 898 | SFR16 | 261 | Q | K | 1.4 | 0.739 | | | 6 |
| 899 | SFR16 | 313 | K | R | 1.4 | 0.758 | | | 6 |
| 900 | SFR16 | 316 | K | Q | 1.3 | 0.685 | | | 6 |
| 901 | SFR16 | 150 | R | E | 1.2 | 0.677 | | | 6 |
| 902 | SFR16 | 500 | R | K | 1.2 | 0.754 | | | 6 |
| 903 | SFR16 | 509 | K | E | 1.1 | 0.537 | | | 6 |
| 904 | SFR16 | 416 | R | Q | 1 | 0.416 | | | 6 |
| 905 | SFR16 | 316 | K | E | 0.5 | 0.061 | | | 6 |
| 906 | SFR16 | 242 | K | R | 0.4 | 0.738 | | | 6 |
| 907 | SFR16 | 313 | K | E | 0.1 | 0.013 | | | 6 |
| 908 | SFR16 | 242 | K | E | 0.1 | 0.011 | | | 6 |
| 909 | SFR16 | 242 | K | Q | 0.1 | 0.011 | | | 6 |
| 910 | SFR16 | 500 | R | E | 0.1 | 0.01 | | | 6 |
| 911 | PSR3 | 339 | E | N | 343.6 | 0 | | | 7 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 912 | PSR3 | 401 | S | H | 32.8 | 0 | | | 7 |
| 913 | PSR3 | 401 | S | P | 21.4 | 0 | | | 7 |
| 914 | PSR3 | 339 | E | I | 14.8 | 0 | | | 7 |
| 915 | PSR3 | 465 | K | N | 14.7 | 0 | | | 7 |
| 916 | PSR3 | 402 | K | R | 11.7 | 0 | | | 7 |
| 917 | PSR3 | 402 | K | G | 8.3 | 0 | | | 7 |
| 918 | PSR3 | 333 | S | G | 7.4 | 0 | | | 7 |
| 919 | PSR3 | 464 | R | D | 7.1 | 0 | | | 7 |
| 920 | PSR3 | 402 | K | W | 6.8 | 0 | | | 7 |
| 921 | PSR3 | 401 | S | G | 6.2 | 0 | | | 7 |
| 922 | PSR3 | 465 | K | V | 5 | 0.002 | | | 7 |
| 923 | PSR3 | 402 | K | H | 4.7 | 0 | | | 7 |
| 924 | PSR3 | 396 | A | L | 4.6 | 0 | | | 7 |
| 925 | PSR3 | 338 | S | H | 4.6 | 0.001 | | | 7 |
| 926 | PSR3 | 464 | R | K | 4.3 | 0 | | | 7 |
| 927 | PSR3 | 465 | K | M | 4.3 | 0 | | | 7 |
| 928 | PSR3 | 333 | S | K | 4.3 | 0 | | | 7 |
| 929 | PSR3 | 464 | R | A | 4 | 0 | | | 7 |
| 930 | PSR3 | 396 | A | K | 3.9 | 0 | | | 7 |
| 931 | PSR3 | 338 | S | V | 3.2 | 0 | | | 7 |
| 932 | PSR3 | 333 | S | V | 3.1 | 0.005 | | | 7 |
| 933 | PSR3 | 401 | S | K | 3.1 | 0 | | | 7 |
| 934 | PSR3 | 339 | E | P | 3 | 0.026 | | | 7 |
| 935 | PSR3 | 465 | K | P | 2.9 | 0.071 | | | 7 |
| 936 | PSR3 | 396 | A | N | 2.8 | 0.042 | | | 7 |
| 937 | PSR3 | 402 | K | T | 2.8 | 0.06 | | | 7 |
| 938 | PSR3 | 464 | R | S | 2.7 | 0.031 | | | 7 |
| 939 | PSR3 | 463 | A | S | 2.7 | 0.083 | | | 7 |
| 940 | PSR3 | 459 | K | Y | 2.6 | 0.051 | | | 7 |
| 941 | PSR3 | 333 | S | N | 2.6 | 0.051 | | | 7 |
| 942 | PSR3 | 396 | A | G | 2.5 | 0.057 | | | 7 |
| 943 | PSR3 | 464 | R | G | 2.5 | 0.079 | | | 7 |
| 944 | PSR3 | 338 | S | K | 2.5 | 0.008 | | | 7 |
| 945 | PSR3 | 402 | K | N | 2.3 | 0.127 | | | 7 |
| 946 | PSR3 | 465 | K | G | 2.3 | 0.268 | | | 7 |
| 947 | PSR3 | 402 | K | Y | 2.2 | 0.158 | | | 7 |
| 948 | PSR3 | 401 | S | V | 2.2 | 0.024 | | | 7 |
| 949 | PSR3 | 464 | R | H | 2.2 | 0.175 | | | 7 |
| 950 | PSR3 | 465 | K | R | 2.1 | 0.246 | | | 7 |
| 951 | PSR3 | 401 | S | R | 2.1 | 0.206 | | | 7 |
| 952 | PSR3 | 402 | K | M | 2.1 | 0.242 | | | 7 |
| 953 | PSR3 | 338 | S | A | 2 | 0.376 | | | 7 |
| 954 | PSR3 | 464 | R | N | 2 | 0.293 | | | 7 |
| 955 | PSR3 | 459 | K | E | 2 | 0.298 | | | 7 |
| 956 | PSR3 | 465 | K | T | 2 | 0.401 | | | 7 |
| 957 | PSR3 | 333 | S | A | 2 | 0.082 | | | 7 |
| 958 | PSR3 | 338 | S | G | 1.9 | 0.456 | | | 7 |
| 959 | PSR3 | 339 | E | M | 1.9 | 0.368 | | | 7 |
| 960 | PSR3 | 396 | A | I | 1.9 | 0.479 | | | 7 |
| 961 | PSR3 | 338 | S | T | 1.8 | 0.182 | | | 7 |
| 962 | PSR3 | 402 | K | P | 1.8 | 0.587 | | | 7 |
| 963 | PSR3 | 459 | K | P | 1.8 | 0.466 | | | 7 |
| 964 | PSR3 | 333 | S | H | 1.8 | 0.561 | | | 7 |
| 965 | PSR3 | 396 | A | M | 1.8 | 0.213 | | | 7 |
| 966 | PSR3 | 333 | S | Q | 1.7 | 0.254 | | | 7 |
| 967 | PSR3 | 339 | E | S | 1.6 | 0.359 | | | 7 |
| 968 | PSR3 | 401 | S | I | 1.6 | 0.753 | | | 7 |
| 969 | PSR3 | 338 | S | I | 1.6 | 0.756 | | | 7 |
| 970 | PSR3 | 401 | S | N | 1.6 | 0.38 | | | 7 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 971 | PSR3 | 333 | S | T | 1.5 | 0.833 | | | 7 |
| 972 | PSR3 | 339 | E | A | 1.5 | 0.837 | | | 7 |
| 973 | PSR3 | 339 | E | C | 1.5 | 0.485 | | | 7 |
| 974 | PSR3 | 401 | S | F | 1.5 | 0.846 | | | 7 |
| 975 | PSR3 | 463 | A | G | 1.5 | 0.761 | | | 7 |
| 976 | PSR3 | 464 | R | Q | 1.5 | 0.931 | | | 7 |
| 977 | PSR3 | 396 | A | R | 1.5 | 0.538 | | | 7 |
| 978 | PSR3 | 339 | E | F | 1.5 | 0.805 | | | 7 |
| 979 | PSR3 | 338 | S | E | 1.5 | 0.907 | | | 7 |
| 980 | PSR3 | 339 | E | V | 1.4 | 0.674 | | | 7 |
| 981 | PSR3 | 465 | K | H | 1.4 | 0.933 | | | 7 |
| 982 | PSR3 | 465 | K | C | 1.4 | 0.935 | | | 7 |
| 983 | PSR3 | 339 | E | L | 1.4 | 0.741 | | | 7 |
| 984 | PSR3 | 401 | S | T | 1.4 | 0.753 | | | 7 |
| 985 | PSR3 | 401 | S | A | 1.4 | 0.962 | | | 7 |
| 986 | PSR3 | 459 | K | R | 1.4 | 0.962 | | | 7 |
| 987 | PSR3 | 333 | S | D | 1.4 | 0.972 | | | 7 |
| 988 | PSR3 | 339 | E | Q | 1.3 | 0.842 | | | 7 |
| 989 | PSR3 | 464 | R | T | 1.3 | 0.975 | | | 7 |
| 990 | PSR3 | 338 | S | M | 1.3 | 0.857 | | | 7 |
| 991 | PSR3 | 338 | S | R | 1.3 | 0.89 | | | 7 |
| 992 | PSR3 | 333 | S | I | 1.3 | 0.904 | | | 7 |
| 993 | PSR3 | 465 | K | W | 1.3 | 0.864 | | | 7 |
| 994 | PSR3 | 338 | S | P | 1.3 | 0.921 | | | 7 |
| 995 | PSR3 | 333 | S | L | 1.3 | 0.847 | | | 7 |
| 996 | PSR3 | 459 | K | H | 1.3 | 0.824 | | | 7 |
| 997 | PSR3 | 338 | S | D | 1.3 | 0.979 | | | 7 |
| 998 | PSR3 | 465 | K | F | 1.2 | 0.881 | | | 7 |
| 999 | PSR3 | 402 | K | F | 1.2 | 0.793 | | | 7 |
| 1000 | PSR3 | 339 | E | D | 1.2 | 0.795 | | | 7 |
| 1001 | PSR3 | 337 | A | V | 1.2 | 0.899 | | | 7 |
| 1002 | PSR3 | 338 | S | N | 1.2 | 0.883 | | | 7 |
| 1003 | PSR3 | 465 | K | A | 1.2 | 0.796 | | | 7 |
| 1004 | PSR3 | 396 | A | Y | 1.1 | 0.747 | | | 7 |
| 1005 | PSR3 | 401 | S | D | 1.1 | 0.701 | | | 7 |
| 1006 | PSR3 | 333 | S | C | 1.1 | 0.741 | | | 7 |
| 1007 | PSR3 | 339 | E | W | 1.1 | 0.681 | | | 7 |
| 1008 | PSR3 | 333 | S | E | 1.1 | 0.658 | | | 7 |
| 1009 | PSR3 | 337 | A | G | 1.1 | 0.656 | | | 7 |
| 1010 | PSR3 | 459 | K | W | 1.1 | 0.7 | | | 7 |
| 1011 | PSR3 | 401 | S | M | 1.1 | 0.694 | | | 7 |
| 1012 | PSR3 | 401 | S | Q | 1.1 | 0.635 | | | 7 |
| 1013 | PSR3 | 465 | K | L | 1.1 | 0.634 | | | 7 |
| 1014 | PSR3 | 396 | A | Q | 1.1 | 0.697 | | | 7 |
| 1015 | PSR3 | 402 | K | A | 1.1 | 0.629 | | | 7 |
| 1016 | PSR3 | 401 | S | E | 1.1 | 0.674 | | | 7 |
| 1017 | PSR3 | 333 | S | R | 1.1 | 0.649 | | | 7 |
| 1018 | PSR3 | 339 | E | H | 1.1 | 0.642 | | | 7 |
| 1019 | PSR3 | 338 | S | L | 1.1 | 0.636 | | | 7 |
| 1020 | PSR3 | 396 | A | H | 1 | 0.562 | | | 7 |
| 1021 | PSR3 | 464 | R | F | 1 | 0.587 | | | 7 |
| 1022 | PSR3 | 402 | K | L | 1 | 0.549 | | | 7 |
| 1023 | PSR3 | 339 | E | R | 1 | 0.549 | | | 7 |
| 1024 | PSR3 | 465 | K | I | 1 | 0.575 | | | 7 |
| 1025 | PSR3 | 464 | R | I | 1 | 0.553 | | | 7 |
| 1026 | PSR3 | 402 | K | D | 1 | 0.54 | | | 7 |
| 1027 | PSR3 | 333 | S | F | 0.9 | 0.509 | | | 7 |
| 1028 | PSR3 | 465 | K | Q | 0.9 | 0.634 | | | 7 |
| 1029 | PSR3 | 465 | K | D | 0.9 | 0.488 | | | 7 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 1030 | PSR3 | 396 | A | T | 0.9 | 0.409 | | | 7 |
| 1031 | PSR3 | 465 | K | Y | 0.9 | 0.479 | | | 7 |
| 1032 | PSR3 | 464 | R | V | 0.9 | 0.467 | | | 7 |
| 1033 | PSR3 | 338 | S | Q | 0.9 | 0.382 | | | 7 |
| 1034 | PSR3 | 401 | S | L | 0.9 | 0.434 | | | 7 |
| 1035 | PSR3 | 459 | K | V | 0.9 | 0.457 | | | 7 |
| 1036 | PSR3 | 464 | R | L | 0.9 | 0.447 | | | 7 |
| 1037 | PSR3 | 465 | K | S | 0.9 | 0.409 | | | 7 |
| 1038 | PSR3 | 339 | E | Y | 0.9 | 0.407 | | | 7 |
| 1039 | PSR3 | 459 | K | Q | 0.9 | 0.422 | | | 7 |
| 1040 | PSR3 | 333 | S | M | 0.8 | 0.395 | | | 7 |
| 1041 | PSR3 | 463 | A | I | 0.8 | 0.411 | | | 7 |
| 1042 | PSR3 | 401 | S | Y | 0.8 | 0.318 | | | 7 |
| 1043 | PSR3 | 396 | A | V | 0.8 | 0.287 | | | 7 |
| 1044 | PSR3 | 463 | A | C | 0.8 | 0.382 | | | 7 |
| 1045 | PSR3 | 339 | E | G | 0.8 | 0.27 | | | 7 |
| 1046 | PSR3 | 400 | K | D | 0.8 | 0.27 | | | 7 |
| 1047 | PSR3 | 400 | K | Y | 0.8 | 0.267 | | | 7 |
| 1048 | PSR3 | 338 | S | F | 0.8 | 0.259 | | | 7 |
| 1049 | PSR3 | 459 | K | C | 0.8 | 0.361 | | | 7 |
| 1050 | PSR3 | 396 | A | S | 0.8 | 0.249 | | | 7 |
| 1051 | PSR3 | 400 | K | H | 0.8 | 0.23 | | | 7 |
| 1052 | PSR3 | 400 | K | R | 0.8 | 0.228 | | | 7 |
| 1053 | PSR3 | 459 | K | T | 0.7 | 0.328 | | | 7 |
| 1054 | PSR3 | 402 | K | I | 0.7 | 0.308 | | | 7 |
| 1055 | PSR3 | 464 | R | Y | 0.7 | 0.314 | | | 7 |
| 1056 | PSR3 | 464 | R | P | 0.7 | 0.298 | | | 7 |
| 1057 | PSR3 | 339 | E | K | 0.7 | 0.188 | | | 7 |
| 1058 | PSR3 | 402 | K | Q | 0.7 | 0.273 | | | 7 |
| 1059 | PSR3 | 333 | S | P | 0.7 | 0.169 | | | 7 |
| 1060 | PSR3 | 400 | K | N | 0.7 | 0.167 | | | 7 |
| 1061 | PSR3 | 333 | S | Y | 0.7 | 0.256 | | | 7 |
| 1062 | PSR3 | 400 | K | L | 0.6 | 0.242 | | | 7 |
| 1063 | PSR3 | 459 | K | S | 0.6 | 0.24 | | | 7 |
| 1064 | PSR3 | 333 | S | W | 0.6 | 0.246 | | | 7 |
| 1065 | PSR3 | 339 | E | T | 0.6 | 0.237 | | | 7 |
| 1066 | PSR3 | 400 | K | M | 0.6 | 0.13 | | | 7 |
| 1067 | PSR3 | 396 | A | F | 0.6 | 0.235 | | | 7 |
| 1068 | PSR3 | 401 | S | W | 0.6 | 0.233 | | | 7 |
| 1069 | PSR3 | 459 | K | G | 0.6 | 0.233 | | | 7 |
| 1070 | PSR3 | 402 | K | C | 0.6 | 0.226 | | | 7 |
| 1071 | PSR3 | 465 | K | E | 0.6 | 0.099 | | | 7 |
| 1072 | PSR3 | 400 | K | T | 0.6 | 0.108 | | | 7 |
| 1073 | PSR3 | 396 | A | P | 0.6 | 0.208 | | | 7 |
| 1074 | PSR3 | 338 | S | Y | 0.6 | 0.206 | | | 7 |
| 1075 | PSR3 | 459 | K | I | 0.6 | 0.203 | | | 7 |
| 1076 | PSR3 | 459 | K | A | 0.6 | 0.201 | | | 7 |
| 1077 | PSR3 | 396 | A | E | 0.6 | 0.198 | | | 7 |
| 1078 | PSR3 | 459 | K | F | 0.6 | 0.198 | | | 7 |
| 1079 | PSR3 | 400 | K | S | 0.5 | 0.195 | | | 7 |
| 1080 | PSR3 | 338 | S | W | 0.5 | 0.188 | | | 7 |
| 1081 | PSR3 | 463 | A | V | 0.5 | 0.189 | | | 7 |
| 1082 | PSR3 | 459 | K | L | 0.5 | 0.175 | | | 7 |
| 1083 | PSR3 | 400 | K | A | 0.5 | 0.064 | | | 7 |
| 1084 | PSR3 | 400 | K | Q | 0.5 | 0.056 | | | 7 |
| 1085 | PSR3 | 402 | K | V | 0.4 | 0.146 | | | 7 |
| 1086 | PSR3 | 459 | K | N | 0.4 | 0.14 | | | 7 |
| 1087 | PSR3 | 400 | K | I | 0.4 | 0.047 | | | 7 |
| 1088 | PSR3 | 400 | K | C | 0.4 | 0.13 | | | 7 |

TABLE 8-continued

Table Legends
Table 8. The definitions of the column headings are as follows: "MUT ID", a unique identifier for each substitutions; "Backbone", the SEQ ID corresponding to the polypeptide backbone in which the substitution was made; "Position", amino acid position according to the numbering convention of SEQ ID NO: 2, "Ref. A.A.", the standard single letter code for the amino acid present in the backbone sequence at the indicated position; "Substitution", the standard single letter code for the amino acid present in the mutant sequence at the indicated position; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 (ppm)", EC50 as defined in example 3 with the EC50 dose given in ppm for the toxin portion of the sample; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| MUT ID NO: | Backbone | Position | Ref A.A. | Substitution | FAE | P-value | EC50 (ppm) | Deviation | Example # |
|---|---|---|---|---|---|---|---|---|---|
| 1089 | PSR3 | 464 | R | W | 0.4 | 0.129 | | | 7 |
| 1090 | PSR3 | 402 | K | S | 0.4 | 0.124 | | | 7 |
| 1091 | PSR3 | 459 | K | M | 0.4 | 0.117 | | | 7 |
| 1092 | PSR3 | 396 | A | C | 0.4 | 0.112 | | | 7 |
| 1093 | PSR3 | 396 | A | D | 0.4 | 0.032 | | | 7 |
| 1094 | PSR3 | 402 | K | E | 0.4 | 0.114 | | | 7 |
| 1095 | PSR3 | 400 | K | V | 0.3 | 0.085 | | | 7 |
| 1096 | PSR3 | 459 | K | D | 0.3 | 0.079 | | | 7 |
| 1097 | PSR3 | 400 | K | E | 0.2 | 0.02 | | | 7 |
| 1098 | PSR3 | 463 | A | F | 0.2 | 0.066 | | | 7 |
| 1099 | PSR3 | 463 | A | L | 0.2 | 0.065 | | | 7 |
| 1100 | PSR3 | 337 | A | Q | 0.2 | 0.01 | | | 7 |
| 1101 | PSR3 | 463 | A | M | 0.2 | 0.059 | | | 7 |
| 1102 | PSR3 | 337 | A | F | 0.2 | 0.009 | | | 7 |
| 1103 | PSR3 | 464 | R | E | 0.2 | 0.014 | | | 7 |
| 1104 | PSR3 | 400 | K | G | 0.2 | 0.059 | | | 7 |
| 1105 | PSR3 | 338 | S | C | 0.2 | 0.054 | | | 7 |
| 1106 | PSR3 | 337 | A | S | 0.2 | 0.008 | | | 7 |
| 1107 | PSR3 | 337 | A | T | 0.2 | 0.008 | | | 7 |
| 1108 | PSR3 | 463 | A | T | 0.2 | 0.057 | | | 7 |
| 1109 | PSR3 | 463 | A | N | 0.1 | 0.052 | | | 7 |
| 1110 | PSR3 | 401 | S | C | 0.1 | 0.008 | | | 7 |
| 1111 | PSR3 | 400 | K | F | 0.1 | 0.049 | | | 7 |
| 1112 | PSR3 | 400 | K | W | 0.1 | 0.049 | | | 7 |
| 1113 | PSR3 | 337 | A | C | 0.1 | 0.052 | | | 7 |
| 1114 | PSR3 | 337 | A | W | 0.1 | 0.047 | | | 7 |
| 1115 | PSR3 | 396 | A | W | 0.1 | 0.051 | | | 7 |
| 1116 | PSR3 | 463 | A | D | 0.1 | 0.046 | | | 7 |
| 1117 | PSR3 | 337 | A | Y | 0.1 | 0.006 | | | 7 |
| 1118 | PSR3 | 463 | A | Q | 0.1 | 0.043 | | | 7 |
| 1119 | PSR3 | 463 | A | W | 0.1 | 0.042 | | | 7 |
| 1120 | PSR3 | 337 | A | P | 0.1 | 0.005 | | | 7 |
| 1121 | PSR3 | 337 | A | H | 0.1 | 0.004 | | | 7 |
| 1122 | PSR3 | 337 | A | K | 0.1 | 0.043 | | | 7 |
| 1123 | PSR3 | 337 | A | L | 0.1 | 0.004 | | | 7 |
| 1124 | PSR3 | 463 | A | H | 0.1 | 0.038 | | | 7 |
| 1125 | PSR3 | 337 | A | I | 0.1 | 0.004 | | | 7 |
| 1126 | PSR3 | 337 | A | D | 0.1 | 0.004 | | | 7 |
| 1127 | PSR3 | 337 | A | N | 0.1 | 0.004 | | | 7 |
| 1128 | PSR3 | 463 | A | K | 0.1 | 0.037 | | | 7 |
| 1129 | PSR3 | 337 | A | M | 0 | 0.003 | | | 7 |
| 1130 | PSR3 | 400 | K | P | 0 | 0.037 | | | 7 |
| 1131 | PSR3 | 463 | A | R | 0 | 0.032 | | | 7 |
| 1132 | PSR3 | 463 | A | Y | 0 | 0.031 | | | 7 |
| 1133 | PSR3 | 337 | A | R | 0 | 0.035 | | | 7 |
| 1134 | PSR3 | 463 | A | P | 0 | 0.031 | | | 7 |
| 1135 | PSR3 | 337 | A | E | 0 | 0.035 | | | 7 |

TABLE 9

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 51 | SFR5-014 | 6.2 | 0 | | | 8 |
| 52 | SFR5-001 | 3.8 | 0 | | | 8 |
| 53 | SFR5-007 | 3.6 | 0 | | | 8 |
| 54 | SFR5-010 | 3.3 | 0 | | | 8 |
| 55 | SFR5-009 | 3.3 | 0 | | | 8 |
| 56 | SFR5-003 | 3.2 | 0 | | | 8 |
| 57 | SFR5-017 | 3.1 | 0 | | | 8 |
| 58 | SFR5-006 | 2.4 | 0.015 | | | 8 |
| 59 | SFR5-013 | 2.2 | 0.046 | | | 8 |
| 60 | SFR5-016 | 2.1 | 0.057 | | | 8 |
| 61 | SFR5-004 | 1.9 | 0.139 | | | 8 |
| 62 | SFR5-005 | 1.9 | 0.146 | | | 8 |
| 63 | SFR5-020 | 1.7 | 0.328 | | | 8 |
| 64 | SFR5-002 | 1.5 | 0.487 | | | 8 |
| 65 | SFR5-008 | 1.4 | 0.927 | | | 8 |
| 66 | SFR5-015 | 1.3 | 0.753 | | | 8 |
| 67 | SFR09-007 | | | 3.3 | | 8 |
| 68 | SFR09-005 | | | 2.4 | | 8 |
| 69 | SFR09-002 | | | 2.2 | | 8 |
| 70 | SFR09-004 | | | 2.1 | | 8 |
| 71 | SFR09-006 | | | 2 | | 8 |
| 72 | SFR09-003 | | | 2 | | 8 |
| 73 | SFR10-032 | 17.1 | 0 | | | 8 |
| 74 | SFR10-042 | 12 | 0 | | | 8 |
| 75 | SFR10-72 | 8.9 | 0.003 | | | 8 |
| 76 | SFR10-056 | 8.4 | 0 | | | 8 |
| 77 | SFR10-036 | 8.2 | 0 | | | 8 |
| 78 | SFR10-039 | 7.2 | 0 | | | 8 |
| 79 | SFR10-82 | 6.7 | 0 | | | 8 |
| 80 | SFR10-045 | 6.6 | 0 | | | 8 |
| 81 | SFR10-87 | 6.4 | 0 | | | 8 |
| 82 | SFR10-060 | 6.3 | 0 | | | 8 |
| 83 | SFR10-052 | 5.3 | 0 | | | 8 |
| 84 | SFR10-059 | 4.9 | 0 | | | 8 |
| 85 | SFR10-84 | 4.6 | 0.025 | | | 8 |
| 86 | SFR10-031 | 4.4 | 0 | | | 8 |
| 87 | SFR10-054 | 4.2 | 0 | | | 8 |
| 88 | SFR10-064 | 3.9 | 0 | | | 8 |
| 89 | SFR10-76 | 3.8 | 0 | | | 8 |
| 90 | SFR10-008 | 3.7 | 0 | | | 8 |
| 91 | SFR10-035 | 3.7 | 0 | | | 8 |
| 92 | SFR10-015 | 3.5 | 0 | | | 8 |
| 93 | SFR10-71 | 3.5 | 0 | | | 8 |
| 94 | SFR10-74 | 3.4 | 0 | | | 8 |
| 95 | SFR10-047 | 3.4 | 0 | | | 8 |
| 96 | SFR10-043 | 3.4 | 0.006 | | | 8 |
| 97 | SFR10-055 | 2.9 | 0 | | | 8 |
| 98 | SFR10-065 | 2.8 | 0 | | | 8 |
| 99 | SFR10-041 | 2.8 | 0 | | | 8 |
| 100 | SFR10-83 | 2.8 | 0.006 | | | 8 |
| 101 | SFR10-002 | 2.7 | 0.001 | | | 8 |
| 102 | SFR10-046 | 2.5 | 0.002 | | | 8 |
| 103 | SFR10-037 | 2.5 | 0.002 | | | 8 |
| 104 | SFR10-048 | 2.5 | 0.002 | | | 8 |
| 105 | SFR10-78 | 2.4 | 0 | | | 8 |
| 106 | SFR10-050 | 2.4 | 0 | | | 8 |
| 107 | SFR10-058 | 2.4 | 0.017 | | | 8 |
| 108 | SFR10-020 | 2.4 | 0.009 | | | 8 |
| 109 | SFR10-057 | 2.3 | 0.018 | | | 8 |
| 110 | SFR10-040 | 2.3 | 0.008 | | | 8 |
| 111 | SFR10-75 | 2.3 | 0 | | | 8 |
| 112 | SFR10-73 | 2.3 | 0 | | | 8 |
| 113 | SFR10-049 | 2.2 | 0.044 | | | 8 |
| 114 | SFR10-003 | 2.2 | 0.022 | | | 8 |
| 115 | SFR10-038 | 2.2 | 0.015 | | | 8 |
| 116 | SFR10-024 | 2.2 | 0.022 | | | 8 |
| 117 | SFR10-79 | 2.1 | 0.006 | | | 8 |
| 118 | SFR10-81 | 2 | 0.001 | | | 8 |
| 119 | SFR10-77 | 2 | 0.006 | | | 8 |
| 120 | SFR10-88 | 1.9 | 0.205 | | | 8 |
| 121 | SFR10-051 | 1.9 | 0.109 | | | 8 |
| 122 | SFR10-016 | 1.9 | 0.12 | | | 8 |
| 123 | SFR10-025 | 1.8 | 0.152 | | | 8 |
| 124 | SFR10-017 | 1.6 | 0.364 | | | 8 |
| 125 | SFR10-018 | 1.6 | 0.393 | | | 8 |
| 126 | SFR10-004 | 1.6 | 0.39 | | | 8 |
| 127 | SFR10-029 | 1.6 | 0.395 | | | 8 |
| 128 | SFR10-053 | 1.6 | 0.434 | | | 8 |
| 129 | SFR10-006 | 1.5 | 0.637 | | | 8 |
| 130 | SFR10-80 | 1.4 | 0.113 | | | 8 |
| 131 | SFR10-021 | 1.4 | 0.697 | | | 8 |
| 132 | SFR10-009 | 1.4 | 0.726 | | | 8 |
| 133 | SFR10-007 | 1.4 | 0.728 | | | 8 |
| 134 | SFR10-030 | 1.3 | 0.965 | | | 8 |
| 135 | SFR10-014 | 1.2 | 0.79 | | | 8 |
| 136 | SFR10-044 | 1.2 | 0.8 | | | 8 |
| 137 | SFR10-89 | 1.1 | 0.673 | | | 8 |
| 138 | SFR10-013 | 1.1 | 0.596 | | | 8 |
| 139 | SFR10-011 | 1.1 | 0.588 | | | 8 |
| 140 | SFR10-010 | 1 | 0.457 | | | 8 |
| 141 | SFR10-023 | 0.9 | 0.356 | | | 8 |
| 142 | SFR10-022 | 0.9 | 0.288 | | | 8 |
| 143 | SFR10-027 | 0.9 | 0.264 | | | 8 |
| 144 | SFR10-005 | 0.8 | 0.233 | | | 8 |
| 145 | SFR10-019 | 0.7 | 0.148 | | | 8 |
| 146 | SFR10-028 | 0.7 | 0.093 | | | 8 |
| 147 | SFR10-026 | 0.6 | 0.079 | | | 8 |
| 148 | SFR11-001 | 27.4 | 0 | | | 8 |
| 149 | SFR11-012 | 14.8 | 0 | | | 8 |
| 150 | SFR11-005 | 12.8 | 0 | | | 8 |
| 151 | SFR11-014 | 9.9 | 0 | | | 8 |
| 152 | SFR11-015 | 8.2 | 0 | | | 8 |
| 153 | SFR11-010 | 8.1 | 0 | | | 8 |
| 154 | SFR11-013 | 5.5 | 0 | | | 8 |
| 155 | SFR11-004 | 4.3 | 0 | | | 8 |
| 156 | SFR11-009 | 4 | 0 | | | 8 |
| 157 | SFR11-002 | 4 | 0 | | | 8 |
| 158 | SFR11-011 | 3.9 | 0 | | | 8 |
| 159 | SFR11-007 | 3.8 | 0.007 | | | 8 |
| 160 | SFR11-008 | 3.1 | 0 | | | 8 |
| 161 | SFR11-006 | 2.3 | 0.012 | | | 8 |
| 162 | SFR12-028 | | | 7.6 | | 8 |
| 163 | SFR12-022 | | | 5.7 | | 8 |
| 164 | SFR12-004 | | | 5 | | 8 |
| 165 | SFR12-006 | | | 4.9 | | 8 |
| 166 | SFR12-015 | | | 4.6 | | 8 |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 167 | SFR12-001 | | | 4.6 | | 8 |
| 168 | SFR12-014 | | | 4.6 | | 8 |
| 169 | SFR12-002 | | | 4.5 | | 8 |
| 170 | SFR12-005 | | | 4.4 | | 8 |
| 171 | SFR12-017 | | | 4.2 | | 8 |
| 172 | SFR12-018 | | | 3.9 | | 8 |
| 173 | SFR12-003 | | | 3.9 | | 8 |
| 174 | SFR12-032 | | | 3.5 | | 8 |
| 175 | SFR12-016 | | | 3.2 | | 8 |
| 176 | SFR12-029 | | | 3.2 | | 8 |
| 177 | SFR12-011 | | | 3.2 | | 8 |
| 178 | SFR12-007 | | | 3 | | 8 |
| 179 | SFR12-010 | | | 3 | | 8 |
| 180 | SFR12-012 | | | 2.8 | | 8 |
| 181 | SFR12-009 | | | 2.8 | | 8 |
| 182 | SFR12-031 | | | 2.3 | | 8 |
| 183 | SFR13-035 | 9.3 | 0 | | | 8 |
| 184 | SFR13-018 | 6.1 | 0 | | | 8 |
| 185 | SFR13-039 | 5.4 | 0 | | | 8 |
| 186 | SFR13-008 | 5.3 | 0 | | | 8 |
| 187 | SFR13-012 | 5.3 | 0 | | | 8 |
| 188 | SFR13-036 | 5.2 | 0 | | | 8 |
| 189 | SFR13-009 | 4.8 | 0 | | | 8 |
| 190 | SFR13-025 | 4.8 | 0 | | | 8 |
| 191 | SFR13-033 | 4.7 | 0 | | | 8 |
| 192 | SFR13-038 | 4.5 | 0 | | | 8 |
| 193 | SFR13-003 | 4.5 | 0 | | | 8 |
| 194 | SFR13-021 | 4.3 | 0 | | | 8 |
| 195 | SFR13-030 | 4.3 | 0 | | | 8 |
| 196 | SFR13-017 | 4.2 | 0 | | | 8 |
| 197 | SFR13-004 | 4.2 | 0 | | | 8 |
| 198 | SFR13-006 | 4.1 | 0 | | | 8 |
| 199 | SFR13-026 | 4.1 | 0 | | | 8 |
| 200 | SFR13-016 | 4.1 | 0 | | | 8 |
| 201 | SFR13-031 | 4.1 | 0 | | | 8 |
| 202 | SFR13-034 | 3.7 | 0 | | | 8 |
| 203 | SFR13-007 | 3.7 | 0 | | | 8 |
| 204 | SFR13-029 | 3.7 | 0 | | | 8 |
| 205 | SFR13-024 | 3.6 | 0 | | | 8 |
| 206 | SFR13-020 | 3.4 | 0 | | | 8 |
| 207 | SFR13-001 | 3 | 0 | | | 8 |
| 208 | SFR13-005 | 3 | 0 | | | 8 |
| 209 | SFR13-037 | 2.8 | 0 | | | 8 |
| 210 | SFR13-032 | 2.8 | 0 | | | 8 |
| 211 | SFR13-027 | 2.5 | 0 | | | 8 |
| 212 | SFR13-028 | 2.4 | 0 | | | 8 |
| 213 | SFR13-010 | 2.4 | 0 | | | 8 |
| 214 | SFR13-011 | 2.2 | 0 | | | 8 |
| 215 | SFR13-019 | 2.2 | 0 | | | 8 |
| 216 | SFR13-023 | 2 | 0 | | | 8 |
| 217 | SFR13-022 | 1.3 | 0.322 | | | 8 |
| 218 | SFR14-004 | | | 3.3 | | 8 |
| 219 | SFR14-007 | | | 3.2 | | 8 |
| 220 | SFR14-008 | | | 3.2 | | 8 |
| 221 | SFR14-005 | | | 2.8 | | 8 |
| 222 | SFR14-001 | | | 2.8 | | 8 |
| 223 | SFR14-002 | | | 2 | | 8 |
| 224 | SFR14-003 | | | 1.3 | | 8 |
| 225 | SFR17-013 | 20.9 | 0.002 | | | 8 |
| 226 | SFR17-019 | 20.1 | 0 | | | 8 |
| 227 | SFR17-014 | 19.5 | 0 | | | 8 |
| 228 | SFR17-011 | 19 | 0 | | | 8 |
| 229 | SFR17-005 | 17.1 | 0 | | | 8 |
| 230 | SFR17-018 | 16.5 | 0 | | | 8 |
| 231 | SFR17-009 | 13.5 | 0 | | | 8 |
| 232 | SFR17-006 | 13.1 | 0 | | | 8 |
| 233 | SFR17-016 | 12.9 | 0 | | | 8 |
| 234 | SFR17-012 | 11.7 | 0 | | | 8 |
| 235 | SFR17-004 | 11.3 | 0 | | | 8 |
| 236 | SFR17-017 | 10.5 | 0 | | | 8 |
| 237 | SFR17-003 | 9.7 | 0 | | | 8 |
| 238 | SFR17-001 | 8.7 | 0.01 | | | 8 |
| 239 | SFR17-015 | 8.2 | 0 | | | 8 |
| 240 | SFR17-002 | 7.6 | 0 | | | 8 |
| 241 | SFR17-007 | 5.5 | 0 | | | 8 |
| 242 | SFR17-008 | 4.7 | 0 | | | 8 |
| 243 | P053168-D-01__S03721995 | | | | 0.39 | 9 |
| 244 | P053168-A-10__S03723031 | | | | 0.34 | 9 |
| 245 | P053168-D-06__S03722432 | | | | 0.26 | 9 |
| 246 | P053168-F-07__S03722451 | | | | 0.25 | 9 |
| 247 | P053168-F-10__S03723024 | | | | 0.24 | 9 |
| 248 | P053169-E-10__S03723571 | | | | 0.23 | 9 |
| 249 | P053168-B-03__S03722281 | | | | 0.19 | 9 |
| 250 | P053168-E-10__S03722994 | | | | 0.19 | 9 |
| 251 | P053168-G-09__S03723000 | | | | 0.17 | 9 |
| 252 | P053168-H-05__S03722286 | | | | 0.16 | 9 |
| 253 | P053168-F-04__S03722292 | | | | 0.15 | 9 |
| 254 | P053168-A-03__S03722326 | | | | 0.14 | 9 |
| 255 | P053168-C-04__S03722283 | | | | 0.14 | 9 |
| 256 | P053168-D-07__S03722516 | | | | 0.14 | 9 |
| 257 | P053168-A-12__S03722983 | | | | 0.14 | 9 |
| 258 | P053169-H-01__S03723182 | | | | 0.13 | 9 |
| 259 | P053168-H-11__S03723019 | | | | 0.13 | 9 |
| 260 | P053168-A-02__S03723761 | | | | 0.12 | 9 |
| 261 | P053168-C-10__S03722993 | | | | 0.12 | 9 |
| 262 | P053168-A-07__S03722449 | | | | 0.12 | 9 |
| 263 | P053168-B-08__S03722529 | | | | 0.1 | 9 |
| 264 | P053168-B-12__S03722998 | | | | 0.09 | 9 |
| 265 | P053169-E-12__S03723656 | | | | 0.08 | 9 |
| 266 | P053168-A-08__S03722523 | | | | 0.07 | 9 |
| 267 | P053168-B-04__S03722320 | | | | 0.07 | 9 |
| 268 | P053168-B-10__S03722972 | | | | 0.07 | 9 |
| 269 | P053169-G-11__S03723594 | | | | 0.07 | 9 |
| 270 | P053168-D-11__S03722996 | | | | 0.06 | 9 |
| 271 | P053169-G-01__S03723175 | | | | 0.06 | 9 |
| 272 | P053168-E-05__S03722315 | | | | 0.06 | 9 |
| 273 | P053168-F-08__S03722955 | | | | 0.05 | 9 |
| 274 | P053168-D-05__S03722300 | | | | 0.04 | 9 |
| 275 | P053169-H-02__S03723149 | | | | 0.03 | 9 |
| 276 | P053168-C-06__S03722354 | | | | 0.02 | 9 |
| 277 | P053169-D-06__S03723260 | | | | 0.02 | 9 |
| 278 | P053169-B-08__S03723469 | | | | 0.02 | 9 |
| 279 | P053169-G-08__S03723462 | | | | 0.01 | 9 |
| 280 | P053168-G-04__S03722314 | | | | 0.01 | 9 |
| 281 | P053168-H-08__S03722875 | | | | 0.01 | 9 |
| 282 | P053169-B-12__S03723595 | | | | 0.01 | 9 |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 283 | P053169-D-01__S03723219 | | | | −0.01 | 9 |
| 284 | P053168-G-05__S03722346 | | | | −0.01 | 9 |
| 285 | P053168-A-09__S03722919 | | | | −0.01 | 9 |
| 286 | P053168-A-04__S03722290 | | | | −0.01 | 9 |
| 287 | P053169-F-11__S03723652 | | | | −0.02 | 9 |
| 288 | P053169-H-12__S03723599 | | | | −0.03 | 9 |
| 289 | P053168-F-01__S03723758 | | | | −0.03 | 9 |
| 290 | P053169-H-04__S03723234 | | | | −0.04 | 9 |
| 291 | P053168-A-06__S03722294 | | | | −0.05 | 9 |
| 292 | P053169-G-04__S03723174 | | | | −0.05 | 9 |
| 293 | P053169-A-11__S03723493 | | | | −0.06 | 9 |
| 294 | P053169-B-09__S03723434 | | | | −0.06 | 9 |
| 295 | P053169-G-12__S03723613 | | | | −0.06 | 9 |
| 296 | P053168-B-02__S03723770 | | | | −0.06 | 9 |
| 297 | P053168-G-02__S03722325 | | | | −0.06 | 9 |
| 298 | P053168-H-06__S03722508 | | | | −0.07 | 9 |
| 299 | P053168-C-09__S03723029 | | | | −0.08 | 9 |
| 300 | P053169-E-11__S03723504 | | | | −0.08 | 9 |
| 301 | P053168-F-06__S03722352 | | | | −0.08 | 9 |
| 302 | P053168-D-09__S03722970 | | | | −0.08 | 9 |
| 303 | P053169-D-08__S03723410 | | | | −0.08 | 9 |
| 304 | P053169-F-03__S03723179 | | | | −0.08 | 9 |
| 305 | P053169-G-10__S03723505 | | | | −0.09 | 9 |
| 306 | P053168-D-12__S03723072 | | | | −0.09 | 9 |
| 307 | P053169-H-09__S03723489 | | | | −0.09 | 9 |
| 308 | P053169-A-02__S03723190 | | | | −0.09 | 9 |
| 309 | P053169-B-02__S03723176 | | | | −0.1 | 9 |
| 310 | P053169-B-05__S03723255 | | | | −0.1 | 9 |
| 311 | P053169-H-06__S03723276 | | | | −0.11 | 9 |
| 312 | P053169-A-03__S03723185 | | | | −0.11 | 9 |
| 313 | P053168-D-10__S03723046 | | | | −0.11 | 9 |
| 314 | P053168-E-11__S03722989 | | | | −0.12 | 9 |
| 315 | P053169-F-10__S03723498 | | | | −0.12 | 9 |
| 316 | P053169-G-05__S03723273 | | | | −0.12 | 9 |
| 317 | P053168-H-09__S03722964 | | | | −0.12 | 9 |
| 318 | P053168-E-07__S03722450 | | | | −0.12 | 9 |
| 319 | P053168-G-01__S03723771 | | | | −0.12 | 9 |
| 320 | P053169-F-09__S03723457 | | | | −0.13 | 9 |
| 321 | P053169-B-01__S03723205 | | | | −0.13 | 9 |
| 322 | P053169-F-09__S03723030 | | | | −0.14 | 9 |
| 323 | P053169-C-10__S03723416 | | | | −0.14 | 9 |
| 324 | P053169-A-09__S03723486 | | | | −0.14 | 9 |
| 325 | P053168-C-11__S03723040 | | | | −0.15 | 9 |
| 326 | P053169-D-09__S03723487 | | | | −0.15 | 9 |
| 327 | P053169-A-06__S03723289 | | | | −0.16 | 9 |
| 328 | P053169-C-04__S03723203 | | | | −0.17 | 9 |
| 329 | P053169-C-12__S03723581 | | | | −0.17 | 9 |
| 330 | P053169-C-03__S03723201 | | | | −0.17 | 9 |
| 331 | P053169-C-01__S03723212 | | | | −0.17 | 9 |
| 332 | P053169-F-05__S03723296 | | | | −0.18 | 9 |
| 333 | P053169-B-04__S03723195 | | | | −0.18 | 9 |
| 334 | P053169-C-09__S03723456 | | | | −0.18 | 9 |
| 335 | P053169-E-05__S03723236 | | | | −0.18 | 9 |
| 336 | P053169-D-02__S03723169 | | | | −0.19 | 9 |
| 337 | P053169-D-11__S03723568 | | | | −0.19 | 9 |
| 338 | P053169-E-04__S03723145 | | | | −0.19 | 9 |
| 339 | P053169-F-01__S03723167 | | | | −0.19 | 9 |
| 340 | P053169-B-07__S03723314 | | | | −0.19 | 9 |
| 341 | P053168-G-12__S03723112 | | | | −0.21 | 9 |
| 342 | P053168-H-03__S03722342 | | | | −0.21 | 9 |
| 343 | P053169-E-01__S03723146 | | | | −0.22 | 9 |
| 344 | P053169-B-03__S03723193 | | | | −0.22 | 9 |
| 345 | P053168-C-02__S03723834 | | | | −0.22 | 9 |
| 346 | P053169-G-06__S03723253 | | | | −0.22 | 9 |
| 347 | P053169-C-02__S03723148 | | | | −0.23 | 9 |
| 348 | P053169-B-06__S03723231 | | | | −0.23 | 9 |
| 349 | P053169-G-09__S03723466 | | | | −0.24 | 9 |
| 350 | P053169-H-11__S03723608 | | | | −0.24 | 9 |
| 351 | P053168-H-02__S03722266 | | | | −0.24 | 9 |
| 352 | P053169-H-05__S03723280 | | | | −0.25 | 9 |
| 353 | P053169-E-02__S03723214 | | | | −0.27 | 9 |
| 354 | P053168-H-12__S03723098 | | | | −0.27 | 9 |
| 355 | P053169-B-10__S03723467 | | | | −0.27 | 9 |
| 356 | P053168-E-12__S03723094 | | | | −0.28 | 9 |
| 357 | P053168-F-11__S03722997 | | | | −0.29 | 9 |
| 358 | P053169-H-07__S03723341 | | | | −0.29 | 9 |
| 359 | P053169-F-06__S03723313 | | | | −0.3 | 9 |
| 360 | P053168-E-09__S03722977 | | | | −0.3 | 9 |
| 361 | P053168-G-11__S03723004 | | | | −0.31 | 9 |
| 362 | P053169-E-09__S03723450 | | | | −0.31 | 9 |
| 363 | P053168-A-11__S03722967 | | | | −0.31 | 9 |
| 364 | P053169-D-05__S03723295 | | | | −0.33 | 9 |
| 365 | P053169-F-04__S03723166 | | | | −0.34 | 9 |
| 366 | P053169-F-08__S03723446 | | | | −0.4 | 9 |
| 367 | P053169-A-04__S03723180 | | | | −0.4 | 9 |
| 368 | P053169-E-08__S03723424 | | | | −0.43 | 9 |
| 369 | P053168-G-08__S03722933 | | | | −0.45 | 9 |
| 370 | P053169-C-05__S03723285 | | | | −0.46 | 9 |
| 371 | P053168-B-01__S03722061 | | | | −0.47 | 9 |
| 372 | P053168-E-02__S03722184 | | | | −0.54 | 9 |
| 373 | P053168-G-10__S03722966 | | | | −0.55 | 9 |
| 374 | P053168-D-08__S03722699 | | | | −0.55 | 9 |
| 375 | P053168-G-06__S03722434 | | | | −0.55 | 9 |
| 376 | P053169-D-07__S03723336 | | | | −0.55 | 9 |
| 377 | P053168-C-01__S03722075 | | | | −0.55 | 9 |
| 378 | P053168-C-07__S03722502 | | | | −0.57 | 9 |
| 379 | P053169-C-07__S03723247 | | | | −0.63 | 9 |
| 380 | P053168-E-08__S03722830 | | | | −0.75 | 9 |
| 381 | P053168-B-09__S03722914 | | | | −0.79 | 9 |
| 382 | P053168-F-12__S03723066 | | | | −0.96 | 9 |
| 383 | P053168-D-02__S03722190 | | | | −0.97 | 9 |
| 384 | P053169-G-07__S03723338 | | | | −1.19 | 9 |
| 385 | P053169-F-12__S03723612 | | | | −1.33 | 9 |
| 386 | P053169-H-08__S03723485 | | | | −1.33 | 9 |
| 387 | P053168-G-07__S03722459 | | | | −1.36 | 9 |
| 388 | P053169-E-03__S03723164 | | | | −1.41 | 9 |
| 389 | P053364-A-09__P053168-B-07 \| P053169-H-01 | | | | 0.55 | 9 |
| 390 | P053364-G-01__P053168-D-03 \| P053169-D-12 | | | | 0.51 | 9 |
| 391 | P053364-H-01__P053168-B-07 \| P053169-E-12 | | | | 0.5 | 9 |
| 392 | P053364-A-01__P053168-B-07 \| P053169-D-12 | | | | 0.46 | 9 |
| 393 | P053364-H-08__P053168-B-06 \| P053169-H-03 | | | | 0.42 | 9 |
| 394 | P053364-G-05__P053168-D-03 \| P053169-H-03 | | | | 0.41 | 9 |
| 395 | P053364-A-08__P053168-B-07 \| P053169-A-05 | | | | 0.41 | 9 |
| 396 | P053364-C-01__P053168-H-01 \| P053169-D-12 | | | | 0.39 | 9 |
| 397 | P053364-F-01__P053168-E-03 \| P053169-D-12 | | | | 0.37 | 9 |
| 398 | P053364-C-05__P053168-H-01 \| P053169-H-03 | | | | 0.36 | 9 |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 399 | P053364-B-11__P053168-B-06 \| Axmi205 | | | | 0.36 | 9 |
| 400 | P053364-A-05__P053168-B-07 \| P053169-H-03 | | | | 0.34 | 9 |
| 401 | P053364-F-10__P053168-B-05 \| Axmi205 | | | | 0.33 | 9 |
| 402 | P053364-C-09__P053168-H-01 \| P053169-H-01 | | | | 0.31 | 9 |
| 403 | P053364-B-01__P053168-B-05 \| P053169-D-12 | | | | 0.3 | 9 |
| 404 | P053364-B-09__P053168-B-05 \| P053169-H-01 | | | | 0.29 | 9 |
| 405 | P053364-A-03__P053168-B-07 \| P053169-E-10 | | | | 0.29 | 9 |
| 406 | P053364-A-02__P053168-B-07 \| P053169-A-10 | | | | 0.28 | 9 |
| 407 | P053364-B-04__P053168-B-05 \| P053169-A-12 | | | | 0.28 | 9 |
| 408 | P053364-G-10__P053168-H-01 \| Axmi205 | | | | 0.27 | 9 |
| 409 | P053364-D-01__P053168-H-04 \| P053169-D-12 | | | | 0.27 | 9 |
| 410 | P053364-G-03__P053168-D-03 \| P053169-E-10 | | | | 0.25 | 9 |
| 411 | P053364-B-10__P053168-B-05 \| P053169-A-07 | | | | 0.24 | 9 |
| 412 | P053364-A-10__P053168-B-07 \| P053169-A-07 | | | | 0.24 | 9 |
| 413 | P053364-E-01__P053168-F-05 \| P053169-D-12 | | | | 0.23 | 9 |
| 414 | P053364-H-03__P053168-H-04 \| P053169-E-12 | | | | 0.23 | 9 |
| 415 | P053364-H-10__P053168-H-04 \| Axmi205 | | | | 0.23 | 9 |
| 416 | P053364-B-05__P053168-B-05 \| P053169-H-03 | | | | 0.21 | 9 |
| 417 | P053364-F-02__P053168-E-03 \| P053169-A-10 | | | | 0.2 | 9 |
| 418 | P053364-E-11__P053168-D-03 \| Axmi205 | | | | 0.19 | 9 |
| 419 | P053364-C-03__P053168-H-01 \| P053169-E-10 | | | | 0.19 | 9 |
| 420 | P053364-C-02__P053168-H-01 \| P053169-A-10 | | | | 0.18 | 9 |
| 421 | P053364-B-03__P053168-B-05 \| P053169-E-10 | | | | 0.18 | 9 |
| 422 | P053364-D-09__P053168-H-04 \| P053169-H-01 | | | | 0.16 | 9 |
| 423 | P053364-H-02__P053168-B-05 \| P053169-E-12 | | | | 0.15 | 9 |
| 424 | P053364-G-08__P053168-B-06 \| P053169-A-10 | | | | 0.15 | 9 |
| 425 | P053364-F-04__P053168-E-03 \| P053169-A-12 | | | | 0.15 | 9 |
| 426 | P053364-C-08__P053168-H-01 \| P053169-A-05 | | | | 0.15 | 9 |
| 427 | P053364-F-11__P053168-E-01 \| Axmi205 | | | | 0.14 | 9 |
| 428 | P053364-E-10__P053168-B-07 \| Axmi205 | | | | 0.14 | 9 |
| 429 | P053364-H-09__P053168-A-10 \| P053169-H-03 | | | | 0.13 | 9 |
| 430 | P053364-G-02__P053168-D-03 \| P053169-A-10 | | | | 0.13 | 9 |
| 431 | P053364-E-12__Axmi205 \| P053169-A-05 | | | | 0.13 | 9 |
| 432 | P053364-D-03__P053168-H-04 \| P053169-E-10 | | | | 0.12 | 9 |
| 433 | P053364-F-07__P053168-B-06 \| P053169-D-12 | | | | 0.12 | 9 |
| 434 | P053364-B-02__P053168-B-05 \| P053169-A-10 | | | | 0.1 | 9 |
| 435 | P053364-F-08__P053168-B-06 \| P053169-E-10 | | | | 0.1 | 9 |
| 436 | P053364-A-04__P053168-B-07 \| P053169-A-12 | | | | 0.1 | 9 |
| 437 | P053364-E-02__P053168-F-05 \| P053169-A-10 | | | | 0.1 | 9 |
| 438 | P053364-D-11__P053168-F-05 \| Axmi205 | | | | 0.1 | 9 |
| 439 | P053364-G-04__P053168-D-03 \| P053169-A-12 | | | | 0.09 | 9 |
| 440 | P053364-C-10__P053168-H-01 \| P053169-A-07 | | | | 0.09 | 9 |
| 441 | P053364-C-11__P053168-E-03 \| Axmi205 | | | | 0.09 | 9 |
| 442 | P053364-G-12__Axmi205 \| P053169-A-07 | | | | 0.07 | 9 |
| 443 | P053364-G-07__P053168-A-10 \| P053169-D-12 | | | | 0.06 | 9 |
| 444 | P053364-A-07__P053168-B-07 \| P053169-G-02 | | | | 0.05 | 9 |
| 445 | P053364-C-12__Axmi205 \| P053169-H-03 | | | | 0.03 | 9 |
| 446 | P053364-H-11__Axmi205 \| P053169-A-10 | | | | 0.02 | 9 |
| 447 | P053364-D-02__P053168-H-04 \| P053169-A-10 | | | | 0.01 | 9 |
| 448 | P053364-B-07__P053168-B-05 \| P053169-G-02 | | | | 0.01 | 9 |
| 449 | P053364-E-05__P053168-F-05 \| P053169-H-03 | | | | 0 | 9 |
| 450 | P053364-F-09__P053168-B-06 \| P053169-A-12 | | | | −0.01 | 9 |
| 451 | P053364-H-07__P053168-E-01 \| P053169-A-10 | | | | −0.01 | 9 |
| 452 | P053364-B-08__P053168-B-05 \| P053169-A-05 | | | | −0.02 | 9 |
| 453 | P053364-G-09__P053168-A-10 \| P053169-E-10 | | | | −0.02 | 9 |
| 454 | P053364-C-04__P053168-H-01 \| P053169-A-12 | | | | −0.03 | 9 |
| 455 | P053364-G-11__Axmi205 \| P053169-D-12 | | | | −0.04 | 9 |
| 456 | P053364-F-05__P053168-E-03 \| P053169-H-03 | | | | −0.05 | 9 |
| 457 | P053364-D-12__Axmi205 \| P053169-G-02 | | | | −0.05 | 9 |
| 458 | P053364-H-05__P053168-A-10 \| P053169-A-12 | | | | −0.08 | 9 |
| 459 | P053364-E-03__P053168-F-05 \| P053169-E-10 | | | | −0.09 | 9 |
| 460 | P053364-C-07__P053168-H-01 \| P053169-G-02 | | | | −0.09 | 9 |
| 461 | P053364-D-08__P053168-H-04 \| P053169-A-05 | | | | −0.1 | 9 |
| 462 | P053364-H-04__P053168-H-04 \| P053169-E-12 | | | | −0.11 | 9 |
| 463 | P053364-D-05__P053168-H-04 \| P053169-H-03 | | | | −0.12 | 9 |
| 464 | P053364-D-10__P053168-H-04 \| P053169-A-07 | | | | −0.2 | 9 |
| 465 | P053364-E-07__P053168-E-01 \| P053169-D-12 | | | | −0.22 | 9 |
| 466 | P053364-D-07__P053168-H-04 \| P053169-G-02 | | | | −0.28 | 9 |
| 467 | P053364-B-12__Axmi205 \| P053169-A-12 | | | | −0.3 | 9 |
| 468 | P053364-F-03__P053168-E-03 \| P053169-E-10 | | | | −0.32 | 9 |
| 469 | P053364-D-04__P053168-H-04 \| P053169-A-12 | | | | −0.45 | 9 |
| 470 | P053364-E-08__P053168-E-01 \| P053169-A-10 | | | | −0.47 | 9 |
| 471 | P053364-E-09__P053168-E-01 \| P053169-A-12 | | | | −0.49 | 9 |
| 472 | P052569-H-01__S03656474 | | | | 0.8 | 9 |
| 473 | P052569-H-12__S03657014 | | | | 0.79 | 9 |
| 474 | P052569-A-08__S03656726 | | | | 0.76 | 9 |
| 475 | P052569-G-12__S03657008 | | | | 0.76 | 9 |
| 476 | P052569-G-11__S03656954 | | | | 0.59 | 9 |
| 477 | P052569-F-06__S03656660 | | | | 0.46 | 9 |
| 478 | P052569-H-04__S03656592 | | | | 0.46 | 9 |
| 479 | P052569-E-12__S03656987 | | | | 0.43 | 9 |
| 480 | P052569-A-07__S03656670 | | | | 0.42 | 9 |
| 481 | P052569-H-11__S03656955 | | | | 0.4 | 9 |
| 482 | P052569-F-12__S03657007 | | | | 0.38 | 9 |
| 483 | P052569-C-09__S03656798 | | | | 0.37 | 9 |
| 484 | P052570-E-01__S03657050 | | | | 0.36 | 9 |
| 485 | P052569-E-09__S03656809 | | | | 0.35 | 9 |
| 486 | P052569-D-08__S03656755 | | | | 0.34 | 9 |
| 487 | P052570-H-01__S03657072 | | | | 0.32 | 9 |
| 488 | P052570-D-06__S03657721 | | | | 0.32 | 9 |
| 489 | P052569-D-10__S03656861 | | | | 0.3 | 9 |
| 490 | P052569-F-10__S03656870 | | | | 0.29 | 9 |
| 491 | P052569-E-11__S03656903 | | | | 0.28 | 9 |
| 492 | P052569-B-06__S03656630 | | | | 0.24 | 9 |
| 493 | P052570-C-09__S03657822 | | | | 0.2 | 9 |
| 494 | P052569-C-11__S03656884 | | | | 0.2 | 9 |
| 495 | P052569-C-12__S03656973 | | | | 0.2 | 9 |
| 496 | P052570-H-04__S03657568 | | | | 0.19 | 9 |
| 497 | P052569-A-11__S03656874 | | | | 0.16 | 9 |
| 498 | P052569-A-09__S03656786 | | | | 0.12 | 9 |
| 499 | P052569-A-12__S03656968 | | | | 0.08 | 9 |
| 500 | P052570-B-03__S03657111 | | | | 0.08 | 9 |
| 501 | P052570-A-03__S03657109 | | | | 0.08 | 9 |
| 502 | P052570-E-09__S03657840 | | | | 0.05 | 9 |
| 503 | P052569-C-03__S03656567 | | | | 0 | 9 |
| 504 | P052569-A-10__S03656822 | | | | −0.02 | 9 |
| 505 | P052569-B-05__S03656597 | | | | −0.03 | 9 |
| 506 | P052569-G-07__S03656711 | | | | −0.04 | 9 |
| 507 | P052569-D-11__S03656887 | | | | −0.05 | 9 |
| 508 | P052569-C-01__S03656390 | | | | −0.08 | 9 |
| 509 | P052569-F-08__S03656761 | | | | −0.1 | 9 |
| 510 | P052569-E-03__S03656569 | | | | −0.1 | 9 |
| 511 | P052569-E-01__S03656453 | | | | −0.11 | 9 |
| 512 | P052569-D-06__S03656641 | | | | −0.12 | 9 |
| 513 | P052569-E-04__S03656588 | | | | −0.13 | 9 |
| 514 | P052570-H-09__S03657859 | | | | −0.13 | 9 |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 515 | P052569-G-09__S03656819 | | | | −0.14 | 9 |
| 516 | P052570-B-01__S03657015 | | | | −0.15 | 9 |
| 517 | P052569-C-02__S03656518 | | | | −0.15 | 9 |
| 518 | P052569-G-05__S03656616 | | | | −0.18 | 9 |
| 519 | P052569-B-02__S03656510 | | | | −0.21 | 9 |
| 520 | P052569-G-02__S03656544 | | | | −0.25 | 9 |
| 521 | P052569-F-05__S03656612 | | | | −0.25 | 9 |
| 522 | P052569-B-03__S03656560 | | | | −0.26 | 9 |
| 523 | P052570-E-04__S03657538 | | | | −0.27 | 9 |
| 524 | P052570-G-03__S03657389 | | | | −0.27 | 9 |
| 525 | P052569-A-06__S03656628 | | | | −0.27 | 9 |
| 526 | P052570-E-05__S03657649 | | | | −0.27 | 9 |
| 527 | P052569-F-07__S03656686 | | | | −0.28 | 9 |
| 528 | P052569-B-10__S03656825 | | | | −0.29 | 9 |
| 529 | P052569-C-05__S03656602 | | | | −0.32 | 9 |
| 530 | P052569-E-05__S03656609 | | | | −0.36 | 9 |
| 531 | P052570-G-01__S03657062 | | | | −0.39 | 9 |
| 532 | P052570-F-03__S03657348 | | | | −0.41 | 9 |
| 533 | P052570-F-09__S03657844 | | | | −0.41 | 9 |
| 534 | P052569-C-04__S03656585 | | | | −0.44 | 9 |
| 535 | P052569-F-01__S03656460 | | | | −0.44 | 9 |
| 536 | P052570-F-04__S03657542 | | | | −0.45 | 9 |
| 537 | P052569-A-04__S03656581 | | | | −0.47 | 9 |
| 538 | P052569-H-06__S03656667 | | | | −0.48 | 9 |
| 539 | P052570-H-08__S03657813 | | | | −0.49 | 9 |
| 540 | P052569-F-04__S03656589 | | | | −0.49 | 9 |
| 541 | P052569-D-01__S03656438 | | | | −0.5 | 9 |
| 542 | P052569-H-02__S03656556 | | | | −0.56 | 9 |
| 543 | P052569-C-10__S03656837 | | | | −0.57 | 9 |
| 544 | P052570-A-09__S03657814 | | | | −0.62 | 9 |
| 545 | P052570-A-07__S03657735 | | | | −0.64 | 9 |
| 546 | P052569-H-08__S03656779 | | | | −0.66 | 9 |
| 547 | P052569-D-02__S03656527 | | | | −0.69 | 9 |
| 548 | P052570-C-07__S03657741 | | | | −0.8 | 9 |
| 549 | P052569-D-03__S03656568 | | | | −0.86 | 9 |
| 550 | P052569-B-04__S03656583 | | | | −0.91 | 9 |
| 551 | P052569-G-08__S03656766 | | | | −0.92 | 9 |
| 552 | P052570-E-10__S03657894 | | | | −1.04 | 9 |
| 553 | P052569-G-01__S03656472 | | | | −1.11 | 9 |
| 554 | P052569-D-07__S03656678 | | | | −1.18 | 9 |
| 555 | P052570-A-10__S03657861 | | | | −1.23 | 9 |
| 556 | P052569-B-07__S03656671 | | | | −1.38 | 9 |
| 557 | P052570-B-06__S03657713 | | | | −1.47 | 9 |
| 558 | P052570-A-06__S03657712 | | | | −1.83 | 9 |
| 559 | PSR1-1-076 | 25.6 | 0 | | | 10 |
| 560 | PSR1-1-074 | 22.7 | 0 | | | 10 |
| 561 | PSR1-2-145 | 15.9 | 0 | | | 10 |
| 562 | PSR1-2-082 | 11.6 | 0 | | | 10 |
| 563 | PSR1-2-088 | 11 | 0 | | | 10 |
| 564 | PSR1-2-094 | 10.1 | 0 | | | 10 |
| 565 | PSR1-2-110 | 9.7 | 0 | | | 10 |
| 566 | PSR1-1-073 | 8.5 | 0.003 | | | 10 |
| 567 | PSR1-2-091 | 7.2 | 0 | | | 10 |
| 568 | PSR1-2-149 | 7 | 0 | | | 10 |
| 569 | PSR1-2-087 | 6.9 | 0 | | | 10 |
| 570 | PSR1-2-158 | 6.9 | 0 | | | 10 |
| 571 | PSR1-2-086 | 6.7 | 0 | | | 10 |
| 572 | PSR1-1-053 | 6.5 | 0.011 | | | 10 |
| 573 | PSR1-2-096 | 6.2 | 0 | | | 10 |
| 574 | PSR1-2-135 | 6.1 | 0 | | | 10 |
| 575 | PSR1-1-014 | 5.9 | 0.018 | | | 10 |
| 576 | PSR1-2-141 | 5.8 | 0 | 2.5 | | 10 |
| 577 | PSR1-1-006 | 5.6 | 0.017 | | | 10 |
| 578 | PSR1-2-095 | 5.3 | 0 | | | 10 |
| 579 | PSR1-2-097 | 5.2 | 0 | | | 10 |
| 580 | PSR1-1-039 | 5 | 0.046 | | | 10 |
| 581 | PSR1-1-049 | 4.8 | 0.07 | | | 10 |
| 582 | PSR1-2-127 | 4.6 | 0 | | | 10 |
| 583 | PSR1-2-109 | 4.5 | 0 | | | 10 |
| 584 | PSR1-2-105 | 4.5 | 0 | 1.9 | | 10 |
| 585 | PSR1-2-150 | 4.4 | 0 | | | 10 |
| 586 | PSR1-1-061 | 4.3 | 0.118 | | | 10 |
| 587 | PSR1-1-028 | 4.1 | 0.164 | | | 10 |
| 588 | PSR1-2-128 | 4 | 0 | | | 10 |
| 589 | PSR1-2-151 | 4 | 0 | | | 10 |
| 590 | PSR1-1-045 | 3.9 | 0.185 | | | 10 |
| 591 | PSR1-2-113 | 3.9 | 0 | 1.8 | | 10 |
| 592 | PSR1-1-005 | 3.9 | 0.001 | | | 10 |
| 593 | PSR1-1-036 | 3.8 | 0.229 | | | 10 |
| 594 | PSR1-1-003 | 3.7 | 0.241 | | | 10 |
| 595 | PSR1-2-098 | 3.7 | 0 | 2.1 | | 10 |
| 596 | PSR1-2-138 | 3.7 | 0 | | | 10 |
| 597 | PSR1-2-107 | 3.7 | 0 | | | 10 |
| 598 | PSR1-2-143 | 3.6 | 0 | | | 10 |
| 599 | PSR1-1-001 | 3.5 | 0.282 | | | 10 |
| 600 | PSR1-2-102 | 3.5 | 0 | | | 10 |
| 601 | PSR1-2-093 | 3.5 | 0 | | | 10 |
| 602 | PSR1-1-051 | 3.5 | 0.302 | | | 10 |
| 603 | PSR1-2-101 | 3.5 | 0 | | | 10 |
| 604 | PSR1-1-052 | 3.4 | 0.317 | | | 10 |
| 605 | PSR1-1-033 | 3.4 | 0.324 | | | 10 |
| 606 | PSR1-1-072 | 3.3 | 0.341 | | | 10 |
| 607 | PSR1-2-081 | 3.3 | 0.001 | | | 10 |
| 608 | PSR1-1-065 | 3.3 | 0.383 | | | 10 |
| 609 | PSR1-1-012 | 3.2 | 0.371 | | | 10 |
| 610 | PSR1-2-089 | 3.2 | 0 | 2.7 | | 10 |
| 611 | PSR1-1-063 | 3.2 | 0.399 | | | 10 |
| 612 | PSR1-1-004 | 3.2 | 0.388 | | | 10 |
| 613 | PSR1-1-048 | 3.1 | 0.415 | | | 10 |
| 614 | PSR1-1-058 | 3.1 | 0.425 | | | 10 |
| 615 | PSR1-1-057 | 3.1 | 0.446 | | | 10 |
| 616 | PSR1-1-060 | 3.1 | 0.442 | | | 10 |
| 617 | PSR1-2-142 | 3 | 0.001 | | | 10 |
| 618 | PSR1-2-136 | 3 | 0 | | | 10 |
| 619 | PSR1-2-083 | 2.8 | 0.001 | | | 10 |
| 620 | PSR1-1-066 | 2.7 | 0.575 | | | 10 |
| 621 | PSR1-2-111 | 2.7 | 0.002 | | | 10 |
| 622 | PSR1-2-130 | 2.7 | 0.002 | | | 10 |
| 623 | PSR1-2-112 | 2.7 | 0.022 | | | 10 |
| 624 | PSR1-1-059 | 2.6 | 0.634 | | | 10 |
| 625 | PSR1-1-041 | 2.6 | 0.655 | | | 10 |
| 626 | PSR1-1-030 | 2.6 | 0.656 | | | 10 |
| 627 | PSR1-1-043 | 2.5 | 0.665 | | | 10 |
| 628 | PSR1-1-011 | 2.5 | 0.677 | | | 10 |
| 629 | PSR1-1-021 | 2.5 | 0.684 | | | 10 |
| 630 | PSR1-1-077 | 2.5 | 0.699 | | | 10 |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 631 | PSR1-2-121 | 2.5 | 0.006 | | | 10 |
| 632 | PSR1-2-114 | 2.4 | 0.01 | | | 10 |
| 633 | PSR1-2-154 | 2.3 | 0.032 | | | 10 |
| 634 | PSR1-1-068 | 2.3 | 0.785 | | | 10 |
| 635 | PSR1-2-134 | 2.3 | 0.017 | | | 10 |
| 636 | PSR1-1-019 | 2.3 | 0.787 | | | 10 |
| 637 | PSR1-2-084 | 2.3 | 0.019 | | | 10 |
| 638 | PSR1-1-018 | 2.2 | 0.833 | | | 10 |
| 639 | PSR1-1-013 | 2.2 | 0.837 | | | 10 |
| 640 | PSR1-1-015 | 2.2 | 0.837 | | | 10 |
| 641 | PSR1-1-042 | 2.2 | 0.838 | | | 10 |
| 642 | PSR1-2-090 | 2.2 | 0.035 | | | 10 |
| 643 | PSR1-1-020 | 2.1 | 0.861 | | | 10 |
| 644 | PSR1-1-056 | 2.1 | 0.865 | | | 10 |
| 645 | PSR1-2-157 | 2.1 | 0.055 | | | 10 |
| 646 | PSR1-1-055 | 2.1 | 0.902 | | | 10 |
| 647 | PSR1-1-008 | 2.1 | 0.906 | | | 10 |
| 648 | PSR1-2-147 | 2 | 0.075 | | | 10 |
| 649 | PSR1-2-117 | 2 | 0.097 | | | 10 |
| 650 | PSR1-1-034 | 2 | 0.911 | | | 10 |
| 651 | PSR1-2-137 | 2 | 0.092 | | | 10 |
| 652 | PSR1-1-009 | 2 | 0.922 | | | 10 |
| 653 | PSR1-1-046 | 2 | 0.956 | | | 10 |
| 654 | PSR1-2-099 | 1.9 | 0.153 | | | 10 |
| 655 | PSR1-1-031 | 1.9 | 0.979 | | | 10 |
| 656 | PSR1-1-067 | 1.9 | 0.996 | | | 10 |
| 657 | PSR1-2-106 | 1.9 | 0.17 | | | 10 |
| 658 | PSR1-1-075 | 1.9 | 0.99 | | | 10 |
| 659 | PSR1-2-085 | 1.8 | 0.216 | | | 10 |
| 660 | PSR1-1-029 | 1.7 | 0.933 | | | 10 |
| 661 | PSR1-2-120 | 1.7 | 0.334 | | | 10 |
| 662 | PSR1-1-002 | 1.7 | 0.899 | | | 10 |
| 663 | PSR1-1-024 | 1.6 | 0.879 | | | 10 |
| 664 | PSR1-1-079 | 1.6 | 0.878 | | | 10 |
| 665 | PSR1-2-144 | 1.6 | 0.4 | | | 10 |
| 666 | PSR1-2-122 | 1.6 | 0.454 | | | 10 |
| 667 | PSR1-2-156 | 1.6 | 0.46 | | | 10 |
| 668 | PSR1-2-104 | 1.6 | 0.447 | | | 10 |
| 669 | PSR1-1-026 | 1.6 | 0.854 | | | 10 |
| 670 | PSR1-1-071 | 1.5 | 0.832 | | | 10 |
| 671 | PSR1-1-054 | 1.5 | 0.833 | | | 10 |
| 672 | PSR1-1-064 | 1.5 | 0.83 | | | 10 |
| 673 | PSR1-2-153 | 1.5 | 0.536 | | | 10 |
| 674 | PSR1-2-146 | 1.5 | 0.59 | | | 10 |
| 675 | PSR1-1-032 | 1.5 | 0.814 | | | 10 |
| 676 | PSR1-1-050 | 1.5 | 0.81 | | | 10 |
| 677 | PSR1-2-140 | 1.5 | 0.597 | | | 10 |
| 678 | PSR1-2-125 | 1.5 | 0.59 | | | 10 |
| 679 | PSR1-2-092 | 1.5 | 0.607 | | | 10 |
| 680 | PSR1-1-044 | 1.5 | 0.798 | | | 10 |
| 681 | PSR1-1-010 | 1.5 | 0.791 | | | 10 |
| 682 | PSR1-1-070 | 1.4 | 0.766 | | | 10 |
| 683 | PSR1-2-116 | 1.4 | 0.773 | | | 10 |
| 684 | PSR1-1-035 | 1.4 | 0.745 | | | 10 |
| 685 | PSR1-1-016 | 1.4 | 0.74 | | | 10 |
| 686 | PSR1-1-022 | 1.3 | 0.729 | | | 10 |
| 687 | PSR1-2-152 | 1.3 | 0.881 | | | 10 |
| 688 | PSR1-2-129 | 1.2 | 0.962 | | | 10 |
| 689 | PSR1-2-115 | 1.2 | 0.91 | | | 10 |
| 690 | PSR1-2-100 | 1.2 | 0.845 | | | 10 |
| 691 | PSR1-1-037 | 1.1 | 0.606 | | | 10 |
| 692 | PSR1-2-123 | 1.1 | 0.649 | | | 10 |
| 693 | PSR1-1-038 | 1 | 0.57 | | | 10 |
| 694 | PSR1-2-118 | 1 | 0.544 | | | 10 |
| 695 | PSR1-1-027 | 1 | 0.567 | | | 10 |
| 696 | PSR1-2-124 | 1 | 0.541 | | | 10 |
| 697 | PSR1-1-069 | 1 | 0.564 | | | 10 |
| 698 | PSR1-2-148 | 1 | 0.523 | | | 10 |
| 699 | PSR1-2-103 | 0.9 | 0.35 | | | 10 |
| 700 | PSR1-2-126 | 0.9 | 0.336 | | | 10 |
| 701 | PSR1-1-017 | 0.8 | 0.501 | | | 10 |
| 702 | PSR1-1-023 | 0.8 | 0.499 | | | 10 |
| 703 | PSR1-2-131 | 0.8 | 0.294 | | | 10 |
| 704 | PSR1-2-132 | 0.8 | 0.256 | | | 10 |
| 705 | PSR1-2-132 | 0.7 | 0.17 | | | 10 |
| 706 | PSR1-2-139 | 0.6 | 0.144 | | | 10 |
| 707 | PSR1-2-108 | 0.6 | 0.111 | | | 10 |
| 708 | PSR1-2-133 | 0.6 | 0.11 | | | 10 |
| 709 | PSR1-2-080 | 0.4 | 0.051 | | | 10 |
| 710 | PSR1-1-062 | 0.3 | 0.315 | | | 10 |
| 711 | PSR1-1-078 | 0.3 | 0.303 | | | 10 |
| 712 | PSR1-2-119 | 0.3 | 0.017 | | | 10 |
| 713 | PSR1-1-025 | 0.2 | 0.277 | | | 10 |
| 714 | PSR1-1-040 | 0.2 | 0.263 | | | 10 |
| 715 | PSR1-1-047 | 0.1 | 0.251 | | | 10 |
| 716 | PSR1-1-007 | | 0.204 | | | 10 |
| 717 | PSR7-141 | 10 | | | | 11 |
| 718 | PSR7-63 | 8.4 | | | | 11 |
| 719 | PSR7-89 | 8.1 | | | | 11 |
| 720 | PSR7-94 | 6.6 | | | | 11 |
| 721 | PSR7-106 | 6.1 | | | | 11 |
| 722 | PSR7-96 | 6.1 | | | | 11 |
| 723 | PSR7-100 | 5 | | | | 11 |
| 724 | PSR7-148 | 4.7 | | | | 11 |
| 725 | PSR7-98 | 4.7 | | | | 11 |
| 726 | PSR7-113 | 4.5 | | | | 11 |
| 727 | PSR7-121 | 4.5 | | | | 11 |
| 728 | PSR7-7 | 4.5 | | | | 11 |
| 729 | PSR7-86 | 4.2 | | | | 11 |
| 730 | PSR7-155 | 3.7 | | | | 11 |
| 731 | PSR7-116 | 3.6 | | | | 11 |
| 732 | PSR7-95 | 3.4 | | | | 11 |
| 733 | PSR7-90 | 3.3 | | | | 11 |
| 734 | PSR7-97 | 3.3 | | | | 11 |
| 735 | PSR7-64 | 2.8 | | | | 11 |
| 736 | PSR7-93 | 2.8 | | | | 11 |
| 737 | PSR7-101 | 2.7 | | | | 11 |
| 738 | PSR7-112 | 2.5 | | | | 11 |
| 739 | PSR7-133 | 2.4 | | | | 11 |
| 740 | PSR7-110 | 2.3 | | | | 11 |
| 741 | PSR7-111 | 2.1 | | | | 11 |
| 742 | PSR7-103 | 2.1 | | | | 11 |
| 743 | PSR7-32 | 2.1 | | | | 11 |
| 744 | PSR7-91 | 1.9 | | | | 11 |
| 745 | PSR7-124 | 1.9 | | | | 11 |
| 746 | PSR7-146 | 1.7 | | | | 11 |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 747 | PSR7-136 | 1.6 | | | | 11 |
| 748 | PSR7-41 | 1.5 | | | | 11 |
| 749 | PSR7-159 | 1.5 | | | | 11 |
| 750 | PSR7-138 | 1.3 | | | | 11 |
| 751 | PSR7-156 | 1.1 | | | | 11 |
| 752 | PSR7-135 | 1 | | | | 11 |
| 753 | PSR7-122 | 1 | | | | 11 |
| 754 | PSR7-134 | 0.8 | | | | 11 |
| 755 | PSR7-92 | 0.8 | | | | 11 |
| 756 | PSR7-154 | 0.6 | | | | 11 |
| 757 | PSR7-115 | 0.5 | | | | 11 |
| 758 | PSR8-64 | 15 | | | | 11 |
| 759 | PSR8-11 | 7.9 | | | | 11 |
| 760 | PSR8-40 | 7.5 | | | | 11 |
| 761 | PSR8-58 | 6.6 | | | | 11 |
| 762 | PSR8-70 | 3.3 | | | | 11 |
| 763 | PSR8-69 | 3.1 | | | | 11 |
| 764 | PSR8-49 | 2.9 | | | | 11 |
| 765 | PSR8-55 | 2.4 | | | | 11 |
| 766 | PSR8-43 | 2.1 | | | | 11 |
| 767 | PSR8-28 | 2 | | | | 11 |
| 768 | PSR8-47 | 2 | | | | 11 |
| 769 | PSR8-31 | 1.6 | | | | 11 |
| 770 | PSR8-33 | 1.3 | | | | 11 |
| 771 | PSR8-37 | 1.2 | | | | 11 |
| 772 | PSR8-23 | 1.1 | | | | 11 |
| 773 | PSR8-4 | 1.1 | | | | 11 |
| 774 | PSR8-50 | 1 | | | | 11 |
| 775 | PSR8-39 | 0.9 | | | | 11 |
| 776 | PSR8-42 | 0.9 | | | | 11 |
| 777 | PSR8-9 | 0.9 | | | | 11 |
| 778 | PSR8-63 | 0.7 | | | | 11 |
| 779 | PSR8-8 | 0.6 | | | | 11 |
| 780 | PSR8-17 | 0.6 | | | | 11 |
| 781 | PSR8-34 | 0.5 | | | | 11 |
| 782 | PSR8-53 | 0.3 | | | | 11 |
| 783 | PSR8-44 | 0.3 | | | | 11 |
| 784 | SFR15-009 | 18.8 | 0 | 6.3 | | 12 |
| 785 | SFR15-019 | 8 | 0 | 6.8 | | 12 |
| 786 | SFR15-021 | 7.9 | 0 | 6.9 | | 12 |
| 787 | SFR15-033 | 7.9 | 0 | 4.8 | | 12 |
| 788 | SFR15-020 | 7.3 | 0 | 8.5 | | 12 |
| 789 | SFR15-027 | 7 | 0 | | | 12 |
| 790 | SFR15-036 | 6.6 | 0 | | | 12 |
| 791 | SFR15-007 | 6.6 | 0 | | | 12 |
| 792 | SFR15-017 | 5.5 | 0 | | | 12 |
| 793 | SFR15-015 | 5.5 | 0 | | | 12 |
| 794 | SFR15-005 | 5.4 | 0 | 5.4 | | 12 |
| 795 | SFR15-001 | 5.3 | 0 | 4.7 | | 12 |
| 796 | SFR15-030 | 5.2 | 0 | 3.2 | | 12 |
| 797 | SFR15-025 | 5.1 | 0 | | | 12 |
| 798 | SFR15-011 | 5 | 0 | | | 12 |
| 799 | SFR15-012 | 4.9 | 0 | 6.6 | | 12 |
| 800 | SFR15-029 | 4.7 | 0 | | | 12 |
| 801 | SFR15-016 | 4.7 | 0 | | | 12 |
| 802 | SFR15-010 | 4.5 | 0 | | | 12 |
| 803 | SFR15-003 | 4.5 | 0 | | | 12 |
| 804 | SFR15-023 | 4.4 | 0 | | | 12 |
| 805 | SFR15-006 | 4.3 | 0 | | | 12 |
| 806 | SFR15-028 | 4 | 0 | | | 12 |
| 807 | SFR15-026 | 4 | 0 | | | 12 |
| 808 | SFR15-032 | 3.9 | 0 | | | 12 |
| 809 | SFR15-013 | 3.7 | 0 | | | 12 |
| 810 | SFR15-004 | 3.7 | 0 | | | 12 |
| 811 | SFR15-018 | 3.5 | 0 | | | 12 |
| 812 | SFR15-034 | 3.5 | 0 | | | 12 |
| 813 | SFR15-008 | 3.5 | 0 | | | 12 |
| 814 | SFR15-022 | 3.5 | 0 | | | 12 |
| 815 | SFR15-035 | 3.4 | 0 | | | 12 |
| 816 | SFR15-031 | 3.3 | 0 | | | 12 |
| 817 | SFR15-002 | 3.1 | 0 | | | 12 |
| 818 | SFR15-014 | 2.4 | 0 | | | 12 |
| 819 | SFR15-024 | 2.1 | 0 | | | 12 |
| 820 | SFR12-035 | 12.37 | | | | |
| 821 | SFR12-037 | 9.61 | | | | |
| 822 | SFR12-038 | 12.63 | | | | |
| 823 | SFR12-040 | 9.05 | | | | |
| 824 | SFR17-020 | 27.97 | | | | |
| 825 | SFR17-021 | 5.86 | | | | |
| 826 | SFR17-022 | 7.98 | | | | |
| 827 | SFR18-001 | 7.54 | | | | |
| 828 | SFR18-002 | 7.25 | | | | |
| 829 | SFR18-003 | 5.94 | | | | |
| 830 | SFR18-004 | 7.2 | | | | |
| 831 | SFR18-005 | 8.63 | | | | |
| 832 | SFR18-006 | 6.94 | | | | |
| 833 | SFR18-007 | 11.53 | | | | |
| 834 | SFR18-009 | 7.31 | | | | |
| 835 | SFR19-001 | 21.43 | | | | |
| 836 | SFR19-002 | 11.63 | | | | |
| 837 | SFR19-003 | 10 | | | | |
| 838 | SFR19-004 | 18.62 | | | | |
| 839 | SFR19-005 | 9.79 | | | | |
| 840 | SFR19-007 | 15.94 | | | | |
| 841 | SFR19-008 | 11.06 | | | | |
| 842 | SFR19-009 | 27.29 | | | | |
| 843 | SFR19-010 | 12.85 | | | | |
| 844 | SFR19-011 | 18.24 | | | | |
| 845 | SFR19-012 | 10.92 | | | | |
| 846 | SFR19-013 | 9.13 | | | | |
| 847 | SFR19-014 | 14.13 | | | | |
| 848 | SFR19-015 | 11.32 | | | | |
| 849 | SFR19-016 | 20.96 | | | | |
| 850 | SFR19-017 | 12.41 | | | | |
| 851 | SFR19-018 | 6.18 | | | | |
| 852 | SFR19-019 | 8.49 | | | | |
| 853 | SFR19-020 | 11.78 | | | | |
| 854 | SFR19-021 | 23.45 | | | | |
| 855 | SFR19-022 | 13.51 | | | | |
| 856 | SFR19-023 | 9.31 | | | | |
| 857 | SFR19-024 | 12.15 | | | | |
| 858 | SFR19-025 | 15.25 | | | | |
| 859 | SFR19-026 | 10.59 | | | | |
| 860 | SFR19-028 | 6.97 | | | | |
| 861 | SFR19-031 | 6.39 | | | | |
| 862 | SFR19-032 | 6.54 | | | | |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 863 | SFR19-034 | 6.71 | | | | |
| 864 | SFR19-035 | 20.38 | | | | |
| 865 | SFR19-037 | 7.3 | | | | |
| 866 | SFR19-038 | 9.24 | | | | |
| 867 | SFR19-039 | 6.83 | | | | |
| 868 | SFR19-041 | 14.94 | | | | |
| 869 | SFR19-044 | 13.24 | | | | |
| 870 | SFR19-045 | 9.01 | | | | |
| 871 | SFR19-046 | 7.13 | | | | |
| 872 | SFR19-047 | 16.25 | | | | |
| 873 | SFR19-048 | 19.11 | | | | |
| 874 | SFR19-049 | 16.73 | | | | |
| 875 | SFR19-051 | 8.65 | | | | |
| 876 | SFR19-052 | 9.84 | | | | |
| 877 | SFR19-053 | 9.75 | | | | |
| 878 | SFR19-054 | 10.39 | | | | |
| 879 | SFR19-056 | 10.21 | | | | |
| 880 | SFR19-057 | 15.88 | | | | |
| 881 | SFR19-063 | 10.27 | | | | |
| 882 | SFR19-065 | 8.49 | | | | |
| 883 | SFR19-071 | 9.78 | | | | |
| 884 | SFR19-072 | 9.81 | | | | |
| 885 | SFR19-075 | 17.4 | | | | |
| 886 | SFR19-077 | 37.92 | | | | |
| 887 | SFR19-079 | 37.38 | | | | |
| 888 | SFR19-080 | 18.2 | | | | |
| 889 | SFR20-001 | 7.45 | | | | |
| 890 | SFR20-007 | 6.03 | | | | |
| 891 | SFR20-010 | 8.12 | | | | |
| 892 | SFR20-011 | 7.15 | | | | |
| 893 | SFR20-015 | 6.65 | | | | |
| 894 | SFR20-016 | 6.07 | | | | |
| 895 | SFR20-018 | 7.13 | | | | |
| 896 | SFR20-019 | 9.3 | | | | |
| 897 | SFR20-020 | 16.62 | | | | |
| 898 | SFR20-021 | 7.98 | | | | |
| 899 | SFR20-022 | 6.66 | | | | |
| 900 | SFR20-024 | 7.44 | | | | |
| 901 | SFR20-026 | 7.96 | | | | |
| 902 | SFR20-028 | 11.67 | | | | |
| 903 | SFR20-029 | 7.72 | | | | |
| 904 | SFR20-030 | 6.57 | | | | |
| 905 | SFR20-031 | 5.97 | | | | |
| 906 | SFR20-033 | 6.64 | | | | |
| 907 | SFR20-036 | 7.39 | | | | |
| 908 | SFR20-044 | 8.65 | | | | |
| 909 | SFR20-045 | 14.21 | | | | |
| 910 | SFR20-046 | 15.77 | | | | |
| 911 | SFR20-047 | 17.88 | | | | |
| 912 | SFR20-048 | 6.82 | | | | |
| 913 | SFR20-049 | 13.4 | | | | |
| 914 | SFR20-051 | 6.06 | | | | |
| 915 | SFR20-053 | 11.18 | | | | |
| 916 | SFR20-054 | 12.84 | | | | |
| 917 | SFR20-056 | 10.69 | | | | |
| 918 | SFR20-057 | 7.2 | | | | |
| 919 | SFR20-064 | 9.57 | | | | |
| 920 | SFR20-066 | 5.93 | | | | |
| 921 | SFR20-074 | 27.75 | | | | |
| 922 | SFR20-075 | 14.4 | | | | |
| 923 | SFR20-076 | 12.11 | | | | |
| 924 | SFR21-001 | 18.77 | | | | |
| 925 | SFR21-004 | 9.04 | | | | |
| 926 | SFR21-007 | 10.77 | | | | |
| 927 | SFR21-008 | 16.87 | | | | |
| 928 | SFR21-010 | 11.23 | | | | |
| 929 | SFR21-011 | 12.73 | | | | |
| 930 | SFR21-012 | 13.63 | | | | |
| 931 | SFR21-013 | 8.61 | | | | |
| 932 | SFR21-014 | 9.57 | | | | |
| 933 | SFR21-015 | 9.74 | | | | |
| 934 | SFR21-018 | 9.47 | | | | |
| 935 | SFR21-024 | 13.82 | | | | |
| 936 | SFR22-031 | 21.7 | | 21.71 | | |
| 937 | SFR22-032 | 17.97 | | 17.98 | | |
| 938 | SFR23-001 | 31.56 | | 31.58 | | |
| 939 | SFR23-002 | 20.38 | | 20.39 | | |
| 940 | SFR23-003 | 14.13 | | 14.14 | | |
| 941 | SFR23-004 | 20.27 | | 20.28 | | |
| 942 | SFR23-005 | 12.83 | | 12.83 | | |
| 943 | SFR23-006 | 13.49 | | 13.49 | | |
| 944 | SFR23-007 | 24.97 | | 24.99 | | |
| 945 | SFR23-008 | 12.02 | | 12.03 | | |
| 946 | SFR23-009 | 11.6 | | 11.61 | | |
| 947 | SFR23-010 | 22.49 | | 22.5 | | |
| 948 | SFR23-012 | 27.88 | | 27.89 | | |
| 949 | SFR23-013 | 8.05 | | 8.06 | | |
| 950 | SFR24-006 | 22.58 | | 22.59 | | |
| 951 | SFR24-007 | 9.44 | | 9.44 | | |
| 952 | SFR24-008 | 20.56 | | 20.57 | | |
| 953 | SFR24-015 | 5.87 | | 5.87 | | |
| 954 | SFR24-016 | 18.63 | | 18.64 | | |
| 955 | SFR24-017 | 6.73 | | 6.74 | | |
| 956 | PSR10_SB-003 | 34.27 | | 6.12 | | |
| 957 | PSR10_SA-009 | 31.62 | | 6.17 | | |
| 958 | PSR10_SB-041 | 29.57 | | 7.42 | | |
| 959 | PSR10_SA-077 | 27.77 | | 6.79 | | |
| 960 | PSR10_SA-080 | 26.44 | | 12.65 | | |
| 961 | PSR10_SA-021 | 25.6 | | 10.8 | | |
| 962 | PSR10_SA-061 | 24.99 | | 11.01 | | |
| 963 | PSR10_SB-001 | 23.63 | | 9.38 | | |
| 964 | PSR10_SA-002 | 23.63 | | | | |
| 965 | PSR10_SB-011 | 22.63 | | | | |
| 966 | PSR10_SA-067 | 22.46 | | | | |
| 967 | PSR10_SA-041 | 22.01 | | | | |
| 968 | PSR10_SA-065 | 22 | | 8.01 | | |
| 969 | PSR10_SB-044 | 21.57 | | | | |
| 970 | PSR10_SA-089 | 21.47 | | | | |
| 971 | PSR10_SB-033 | 21.1 | | | | |
| 972 | PSR10_SA-085 | 20.89 | | | | |
| 973 | PSR10_SB-015 | 20.68 | | | | |
| 974 | PSR10_SB-121 | 19.58 | | | | |
| 975 | PSR10_SA-001 | 19.11 | | | | |
| 976 | PSR10_SA-040 | 19.1 | | | | |
| 977 | PSR10_SB-028 | 19.09 | | | | |
| 978 | PSR10_SB-045 | 18.89 | | 6.99 | | |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 979 | PSR10_SB-037 | 18.68 | | | | |
| 980 | PSR10_SB-013 | 18.68 | | | | |
| 981 | PSR10_SA-070 | 18.58 | | | | |
| 982 | PSR10_SB-022 | 18.32 | | | | |
| 983 | PSR10_SA-020 | 18.1 | | | | |
| 984 | PSR10_SA-100 | 18.07 | | | | |
| 985 | PSR10_SB-052 | 17.8 | | | | |
| 986 | PSR10_SB-118 | 17.75 | | | | |
| 987 | PSR10_SA-019 | 17.41 | | | | |
| 988 | PSR10_SB-089 | 17.36 | | | | |
| 989 | PSR10_SB-043 | 17.29 | | | | |
| 990 | PSR10_SB-110 | 17.07 | | | | |
| 991 | PSR10_SB-039 | 16.79 | | | | |
| 992 | PSR10_SA-101 | 16.66 | | | | |
| 993 | PSR10_SA-062 | 16.53 | | | | |
| 994 | PSR10_SA-010 | 16.52 | | | | |
| 995 | PSR10_SA-022 | 16.46 | | | | |
| 996 | PSR10_SA-047 | 16.28 | | | | |
| 997 | PSR10_SB-070 | 16 | | | | |
| 998 | PSR10_SA-017 | 15.89 | | | | |
| 999 | PSR10_SB-020 | 15.72 | | | | |
| 1000 | PSR10_SA-003 | 15.25 | | | | |
| 1001 | PSR10_SB-064 | 15.25 | | | | |
| 1002 | PSR10_SB-069 | 15.12 | | | | |
| 1003 | PSR10_SA-081 | 15.02 | | | | |
| 1004 | PSR10_SB-106 | 14.91 | | | | |
| 1005 | PSR10_SB-012 | 14.88 | | | | |
| 1006 | PSR10_SB-073 | 14.87 | | | | |
| 1007 | PSR10_SA-006 | 14.86 | | | | |
| 1008 | PSR10_SB-068 | 14.82 | | | | |
| 1009 | PSR10_SB-063 | 14.65 | | | | |
| 1010 | PSR10_SB-055 | 14.62 | | | | |
| 1011 | PSR10_SA-050 | 14.62 | | | | |
| 1012 | PSR10_SB-024 | 14.59 | | | | |
| 1013 | PSR10_SB-014 | 14.58 | | | | |
| 1014 | PSR10_SB-081 | 14.57 | | | | |
| 1015 | PSR10_SA-069 | 14.49 | | | | |
| 1016 | PSR10_SA-084 | 14.44 | | | | |
| 1017 | PSR10_SB-108 | 14.42 | | | | |
| 1018 | PSR10_SB-062 | 14.31 | | | | |
| 1019 | PSR10_SB-077 | 14.31 | | | | |
| 1020 | PSR10_SB-102 | 14.31 | | | | |
| 1021 | PSR10_SB-046 | 14.28 | | | | |
| 1022 | PSR10_SB-059 | 14.28 | | | | |
| 1023 | PSR10_SB-016 | 14.21 | | | | |
| 1024 | PSR10_SB-101 | 14.16 | | | | |
| 1025 | PSR10_SA-005 | 14.07 | | 7.58 | | |
| 1026 | PSR10_SB-067 | 14.06 | | | | |
| 1027 | PSR10_SB-002 | 14.06 | | | | |
| 1028 | PSR10_SA-024 | 14.02 | | | | |
| 1029 | PSR10_SB-082 | 13.96 | | | | |
| 1030 | PSR10_SB-095 | 13.93 | | | | |
| 1031 | PSR10_SB-065 | 13.82 | | | | |
| 1032 | PSR10_SB-104 | 13.63 | | | | |
| 1033 | PSR10_SB-117 | 13.57 | | | | |
| 1034 | PSR10_SB-057 | 13.47 | | | | |
| 1035 | PSR10_SA-090 | 13.3 | | | | |
| 1036 | PSR10_SB-019 | 13.23 | | | | |
| 1037 | PSR10_SB-038 | 13.21 | | | | |
| 1038 | PSR10_SA-042 | 13.09 | | | | |
| 1039 | PSR10_SB-010 | 12.93 | | | | |
| 1040 | PSR10_SB-103 | 12.85 | | | | |
| 1041 | PSR10_SA-096 | 12.77 | | | | |
| 1042 | PSR10_SA-068 | 12.74 | | | | |
| 1043 | PSR10_SB-026 | 12.68 | | | | |
| 1044 | PSR10_SB-097 | 12.68 | | | | |
| 1045 | PSR10_SB-009 | 12.59 | | | | |
| 1046 | PSR10_SA-004 | 12.43 | | | | |
| 1047 | PSR10_SA-064 | 12.33 | | | | |
| 1048 | PSR10_SB-025 | 12.3 | | | | |
| 1049 | PSR10_SB-088 | 12.19 | | | | |
| 1050 | PSR10_SB-090 | 12.18 | | | | |
| 1051 | PSR10_SB-036 | 12.15 | | | | |
| 1052 | PSR10_SA-045 | 12.14 | | | | |
| 1053 | PSR10_SB-049 | 12.14 | | | | |
| 1054 | PSR10_SB-021 | 12.13 | | | | |
| 1055 | PSR10_SB-030 | 12.07 | | | | |
| 1056 | PSR10_SA-029 | 12.04 | | | | |
| 1057 | PSR10_SB-066 | 11.97 | | | | |
| 1058 | PSR10_SA-025 | 11.84 | | | | |
| 1059 | PSR10_SB-119 | 11.81 | | | | |
| 1060 | PSR10_SB-076 | 11.79 | | | | |
| 1061 | PSR10_SA-058 | 11.68 | | | | |
| 1062 | PSR10_SB-120 | 11.63 | | | | |
| 1063 | PSR10_SB-004 | 11.61 | | | | |
| 1064 | PSR10_SB-114 | 11.57 | | | | |
| 1065 | PSR10_SA-082 | 11.57 | | | | |
| 1066 | PSR10_SB-053 | 11.55 | | | | |
| 1067 | PSR10_SB-051 | 11.46 | | | | |
| 1068 | PSR10_SB-098 | 11.35 | | | | |
| 1069 | PSR10_SA-118 | 11.3 | | | | |
| 1070 | PSR10_SA-097 | 11.26 | | | | |
| 1071 | PSR10_SB-099 | 11.21 | | | | |
| 1072 | PSR10_SA-099 | 11.17 | | | | |
| 1073 | PSR10_SB-083 | 11.16 | | | | |
| 1074 | PSR10_SA-060 | 11.16 | | | | |
| 1075 | PSR10_SA-095 | 11.13 | | | | |
| 1076 | PSR10_SB-112 | 11.09 | | | | |
| 1077 | PSR10_SA-102 | 11.08 | | | | |
| 1078 | PSR10_SB-007 | 11.02 | | | | |
| 1079 | PSR10_SB-113 | 10.99 | | | | |
| 1080 | PSR10_SB-084 | 10.98 | | | | |
| 1081 | PSR10_SB-115 | 10.98 | | | | |
| 1082 | PSR10_SA-007 | 10.95 | | | | |
| 1083 | PSR10_SA-087 | 10.94 | | | | |
| 1084 | PSR10_SB-111 | 10.93 | | | | |
| 1085 | PSR10_SA-030 | 10.84 | | | | |
| 1086 | PSR10_SB-006 | 10.82 | | | | |
| 1087 | PSR10_SB-105 | 10.8 | | | | |
| 1088 | PSR10_SB-075 | 10.74 | | | | |
| 1089 | PSR10_SA-086 | 10.65 | | | | |
| 1090 | PSR10_SB-040 | 10.59 | | | | |
| 1091 | PSR10_SB-060 | 10.5 | | | | |

TABLE 9-continued

Table 9. The definitions of the column headings are as follows: "SEQ ID NO:", a unique identifier for each DNA or amino acid sequence; "Trivial Name", a trivial but unique name for each DNA or protein sequence; "Reference Protein", the SEQ ID NO corresponding to the reference protein used in the FAE assays for each variant; "FAE", the arithmetic Mean FAE Index as further defined in Example 3; "p-value" the calculated p value associated with the hypothesis that the variant polypeptide is significantly different than the reference protein used in that particular FAE assay, as defined further in Example 3; "EC50 Fold", the fold increase in potency as defined by ratio of reference EC50 to variant EC50 is calculated in each of multiple experiments and then the mean of these independently measured numbers is reported as "EC50 Fold"; "Deviation", Mean Deviation Score as defined in Example 4; "Example #", the example number corresponding to the creation of the variant. The reference protein against which the variant protein is compared is: (MUT IDs: 1-872 and 911-1135) used SEQ ID NO: 6 as the reference protein; (MUT IDs: 873-910) used SEQ ID NO: 8 as the reference protein.

| SEQ ID NO: | Trivial Name | FAE | P-value | EC50 Fold | Deviation | Example # |
|---|---|---|---|---|---|---|
| 1092 | PSR10_SA-098 | 10.45 | | | | |
| 1093 | PSR10_SA-011 | 10.42 | | | | |
| 1094 | PSR10_SA-023 | 10.41 | | | | |
| 1095 | PSR10_SB-017 | 10.41 | | 6.94 | | |
| 1096 | PSR10_SB-116 | 10.36 | | | | |
| 1097 | PSR10_SB-029 | 10.35 | | | | |
| 1098 | PSR10_SA-038 | 10.3 | | | | |
| 1099 | PSR10_SA-033 | 10.25 | | | | |
| 1100 | PSR10_SA-093 | 10.18 | | | | |
| 1101 | PSR10_SA-057 | 10.16 | | | | |
| 1102 | PSR10_SB-092 | 10.09 | | | | |
| 1103 | PSR10_SB-078 | 10.05 | | | | |
| 1104 | PSR10_SB-023 | 10.02 | | | | |
| 1105 | PSR10_SB-027 | 9.95 | | | | |
| 1106 | PSR10_SA-037 | 9.93 | | | | |
| 1107 | PSR10_SB-042 | 9.92 | | | | |
| 1108 | PSR10_SB-080 | 9.9 | | | | |
| 1109 | PSR10_SB-031 | 9.88 | | | | |
| 1110 | PSR10_SB-107 | 9.87 | | | | |
| 1111 | PSR10_SB-050 | 9.84 | | | | |
| 1112 | PSR10_SB-005 | 9.81 | | | | |
| 1113 | PSR10_SA-107 | 9.79 | | | | |
| 1114 | PSR10_SB-074 | 9.74 | | | | |
| 1115 | PSR10_SA-018 | 9.58 | | | | |
| 1116 | PSR10_SB-054 | 9.53 | | | | |
| 1117 | PSR10_SB-035 | 9.48 | | | | |
| 1118 | PSR10_SA-106 | 9.21 | | | | |
| 1119 | PSR10_SA-120 | 9.13 | | | | |
| 1120 | PSR10_SB-091 | 8.84 | | | | |
| 1121 | PSR10_SB-058 | 8.76 | | | | |
| 1122 | PSR10_SA-026 | 8.7 | | | | |
| 1123 | PSR10_SA-052 | 8.69 | | | | |
| 1124 | PSR10_SA-078 | 8.66 | | | | |
| 1125 | PSR10_SB-061 | 8.63 | | | | |
| 1126 | PSR10_SA-110 | 8.59 | | | | |
| 1127 | PSR10_SB-048 | 8.54 | | | | |
| 1128 | PSR10_SB-032 | 8.49 | | | | |
| 1129 | PSR10_SB-008 | 8.45 | | | | |
| 1130 | PSR11-2-016 | 32.82 | | | | |
| 1131 | PSR11-2-077 | 30.06 | | | | |
| 1132 | PSR11-2-061 | 29.88 | | | | |
| 1133 | PSR11-2-072 | 29.67 | | | | |
| 1134 | PSR11-2-038 | 29.12 | | | | |
| 1135 | PSR11-2-008 | 27.23 | | | | |
| 1136 | PSR11-2-059 | 27.22 | | | | |
| 1137 | PSR11-2-063 | 25.89 | | | | |
| 1138 | PSR11-2-009 | 25 | | | | |
| 1139 | PSR11-2-065 | 21.97 | | | | |
| 1140 | PSR11-2-022 | 20.39 | | | | |
| 1141 | PSR11__188 | 18.95 | | | | |
| 1142 | PSR11-2-070 | 18.79 | | | | |
| 1143 | PSR11-2-024 | 18.6 | | | | |
| 1144 | PSR11-2-051 | 17.84 | | | | |
| 1145 | PSR11__004 | 16.81 | | | | |
| 1146 | PSR11__065 | 16.55 | | | | |
| 1147 | PSR11__071 | 15.61 | | | | |
| 1148 | PSR11-2-068 | 15.48 | | | | |
| 1149 | PSR11__120 | 14.6 | | | | |
| 1150 | PSR11__002 | 14.22 | | | | |
| 1151 | PSR11-2-020 | 14.15 | | | | |
| 1152 | PSR11-2-053 | 13.8 | | | | |
| 1153 | PSR11-2-067 | 13.16 | | | | |
| 1154 | PSR11-2-021 | 13.1 | | | | |
| 1155 | PSR11-2-047 | 11.41 | | | | |
| 1156 | PSR11__069 | 11.3 | | | | |
| 1157 | PSR11-2-033 | 10.94 | | | | |
| 1158 | PSR11__010 | 10.22 | | | | |
| 1159 | PSR11-2-044 | 10.2 | | | | |
| 1160 | PSR11-2-004 | 9.91 | | | | |
| 1161 | PSR11-2-025 | 8.62 | | | | |
| 1162 | PSR11-2-054 | 8.45 | | | | |
| 1518 | SFR12-020 | | | 5.66 | | |
| 1519 | SFR12-033 | | | 9.74 | | |
| 1520 | SFR12-034 | | | 8.87 | | |
| 1521 | SFR12-036 | | | 9.11 | | |
| 1522 | SFR18-008 | | | 5.36 | | |
| 1523 | SFR18-010 | | | 5.67 | | |
| 1524 | SFR18-011 | | | 5.81 | | |
| 1525 | SFR21-016 | | | 6.61 | | |
| 1526 | SFR21-017 | | | 7.89 | | |

SEQUENCE LISTING (1535 sequences)

SEQ ID NO: 1 - DNA, 1611 bp, Artificial Sequence
  PHI-4 polypeptide variant
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaaggattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 2 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 3 - protein, 536 aa, Artificial Sequence
  PHI-4 polypeptide variant
  MISC_FEATURE (2)..(2): Xaa at position 2 is Ala or Arg
  MISC_FEATURE (9)..(9): Xaa at position 9 is Gln, Lys or Glu
  MISC_FEATURE (14)..(14): Xaa at position 14 is Pro or Ala
  MISC_FEATURE (16)..(16): Xaa at position 16 is Val or Asp
  MISC_FEATURE (19)..(19): Xaa at position 19 is Met or Leu
  MISC_FEATURE (22)..(22): Xaa at position 22 is Gly or Ser
  MISC_FEATURE (24)..(24): Xaa at position 24 is Asp, Asn or Gln
  MISC_FEATURE (36)..(36): Xaa at position 36 is Leu or Met
  MISC_FEATURE (42)..(42): Xaa at position 42 is Asp, Asn or Gln
  MISC_FEATURE (43)..(43): Xaa at position 43 is Phe or Glu
  MISC_FEATURE (46)..(46): Xaa at position 46 is Glu, Asp, Asn or Gly
  MISC_FEATURE (50)..(50): Xaa at position 50 is Ile or Val
  MISC_FEATURE (51)..(51): Xaa at position 51 is Glu or Gln
  MISC_FEATURE (55)..(55): Xaa at position 55 is Arg or Lys
  MISC_FEATURE (56)..(56): Xaa at position 56 is Ser or Thr
  MISC_FEATURE (57)..(57): Xaa at position 57 is Tyr or Phe
  MISC_FEATURE (58)..(58): Xaa at position 58 is Thr or Ser
  MISC_FEATURE (61)..(61): Xaa at position 61 is Arg, Lys or Glu
  MISC_FEATURE (73)..(73): Xaa at position 73 is Phe or Tyr
  MISC_FEATURE (74)..(74): Xaa at position 74 is Lys, Glu, Gly, Arg, Met, Leu, His or Asp
  MISC_FEATURE (76)..(76): Xaa at position 76 is Asp or Gln
  MISC_FEATURE (79)..(79): Xaa at position 79 is Lys or Glu
  MISC_FEATURE (80)..(80): Xaa at position 80 is Glu or Ser
  MISC_FEATURE (82)..(82): Xaa at position 82 is Glu, Ile, Leu, Tyr or Gln
  MISC_FEATURE (83)..(83): Xaa at position 83 is Glu or Gln
  MISC_FEATURE (84)..(84): Xaa at position 84 is Tyr or Phe
  MISC_FEATURE (86)..(86): Xaa at position 86 is Glu or Gln
  MISC_FEATURE (87)..(87): Xaa at position 87 is Lys or Gln
  MISC_FEATURE (88)..(88): Xaa at position 88 is Met, Ile or Leu
  MISC_FEATURE (90)..(90): Xaa at position 90 is Gln or Glu
  MISC_FEATURE (94)..(94): Xaa at position 94 is Val or Ile
  MISC_FEATURE (97)..(97): Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu
  MISC_FEATURE (98)..(98): Xaa at position 98 is Tyr or Phe
  MISC_FEATURE (99)..(99): Xaa at position 99 is Lys, Leu, Tyr, Ile, Met, Phe, Cys, Val or Asn
  MISC_FEATURE (103)..(103): Xaa at position 103 is Ala or Gly
  MISC_FEATURE (105)..(105): Xaa at position 105 is Leu or Ile
  MISC_FEATURE (109)..(109): Xaa at position 109 is Phe, Lys, Gly, Met, Ser, Asp, Asn, Glu, Cys, Ala or Arg
  MISC_FEATURE (112)..(112): Xaa at position 112 is Thr or Ser
  MISC_FEATURE (113)..(113): Xaa at position 113 is Asp, Glu or Met
  MISC_FEATURE (117)..(117): Xaa at position 117 is Thr or Ser
  MISC_FEATURE (121)..(121): Xaa at position 121 is Tyr or Phe
  MISC_FEATURE (127)..(127): Xaa at position 127 is Ala or Thr
  MISC_FEATURE (142)..(142): Xaa at position 142 is Arg or Glu
  MISC_FEATURE (146)..(146): Xaa at position 146 is Arg or Gln
  MISC_FEATURE (147)..(147): Xaa at position 147 is Arg, Glu or Gln
  MISC_FEATURE (148)..(148): Xaa at position 148 is Asp, Phe, Pro, Val, Glu, His, Trp, Ala, Arg, Leu, Ser, Gln or Gly
  MISC_FEATURE (149)..(149): Xaa at position 149 is Phe or Val
  MISC_FEATURE (150)..(150): Xaa at position 150 is Arg, Gln, Glu or Asn
  MISC_FEATURE (151)..(151): Xaa at position 151 is Asp, Ser, Ala, Asn, Trp, Val, Gln, Cys, Met, Leu, Arg or Glu
  MISC_FEATURE (153)..(153): Xaa at position 153 is Leu or Ile
  MISC_FEATURE (154)..(154): Xaa at position 154 is Asn or Asp
  MISC_FEATURE (155)..(155): Xaa at position 155 is Asn or Lys
  MISC_FEATURE (159)..(159): Xaa at position 159 is Pro or Asp
  MISC_FEATURE (162)..(162): Xaa at position 162 is Glu, Asp, Gln, Asn or Leu
  MISC_FEATURE (165)..(165): Xaa at position 165 is Lys, Glu, Gln, Pro, Thr, Ala, Leu, Gly, Asp, Val, His, Ile, Met, Trp, Phe, Tyr or Arg
  MISC_FEATURE (166)..(166): Xaa at position 166 is Arg or Gln
  MISC_FEATURE (167)..(167): Xaa at position 167 is Tyr, Trp or Cys
  MISC_FEATURE (170)..(170): Xaa at position 170 is Tyr or His
  MISC_FEATURE (171)..(171): Xaa at position 171 is Tyr or Phe
  MISC_FEATURE (172)..(172): Xaa at position 172 is Ile, Leu or Val
  MISC_FEATURE (173)..(173): Xaa at position 173 is Ser or Ala
  MISC_FEATURE (174)..(174): Xaa at position 174 is Glu, Gln, Asn, Lys, Val or Ser
  MISC_FEATURE (182)..(182): Xaa at position 182 is Asp or Gln
  MISC_FEATURE (183)..(183): Xaa at position 183 is Tyr or Val
  MISC_FEATURE (184)..(184): Xaa at position 184 is Ser or Thr
  MISC_FEATURE (185)..(185): Xaa at position 185 is Ala or Ser
  MISC_FEATURE (189)..(189): Xaa at position 189 is Thr, Lys or Ile
  MISC_FEATURE (191)..(191): Xaa at position 191 is Lys or Gln
  MISC_FEATURE (193)..(193): Xaa at position 193 is Asp or Asn
  MISC_FEATURE (196)..(196): Xaa at position 196 is Gln, Lys, Asn, Asp, Glu, Ala, Ile or Arg
  MISC_FEATURE (202)..(202): Xaa at position 202 is Ala or Val
  MISC_FEATURE (203)..(203): Xaa at position 203 is Glu, Thr or His
  MISC_FEATURE (204)..(204): Xaa at position 204 is Met or Ala
  MISC_FEATURE (206)..(206): Xaa at position 206 is Tyr or Phe
  MISC_FEATURE (207)..(207): Xaa at position 207 is Lys or Gln
  MISC_FEATURE (209)..(209): Xaa at position 209 is Leu or Pro
  MISC_FEATURE (210)..(210): Xaa at position 210 is Val or Ile
  MISC_FEATURE (214)..(214): Xaa at position 214 is Lys, Ser or Gln
  MISC_FEATURE (216)..(216): Xaa at position 216 is Glu, Gln, Phe, Val, Tyr or Arg
  MISC_FEATURE (220)..(220): Xaa at position 220 is Glu, His, Asp, Thr, Tyr, Val, Ser, Gln, Arg, Trp, Met, Ala, Phe, Ile, Leu, Cys or Asn
  MISC_FEATURE (229)..(229): Xaa at position 229 is Arg or Glu
  MISC_FEATURE (230)..(230): Xaa at position 230 is Ser or Glu
  MISC_FEATURE (231)..(231): Xaa at position 231 is Asn or Ser
  MISC_FEATURE (236)..(236): Xaa at position 236 is Leu or Pro
  MISC_FEATURE (245)..(245): Xaa at position 245 is Met or Leu
  MISC_FEATURE (247)..(247): Xaa at position 247 is Asp or Tyr
  MISC_FEATURE (256)..(256): Xaa at position 256 is Gln, Lys or Glu
  MISC_FEATURE (257)..(257): Xaa at position 257 is Gln, Ile, Glu, Cys, Ser, His, Trp or Met
  MISC_FEATURE (261)..(261): Xaa at position 261 is Gln, Glu, Lys or Ala
  MISC_FEATURE (264)..(264): Xaa at position 264 is Glu or Gln
  MISC_FEATURE (268)..(268): Xaa at position 268 is Asp or Asn
  MISC_FEATURE (276)..(276): Xaa at position 276 is Ser or Ala
  MISC_FEATURE (278)..(278): Xaa at position 278 is Glu, Asn or Gln
  MISC_FEATURE (281)..(281): Xaa at position 281 is Gln, Lys or Glu
  MISC_FEATURE (282)..(282): Xaa at position 282 is Pro or Gly
  MISC_FEATURE (284)..(284): Xaa at position 284 is Trp or Arg
  MISC_FEATURE (287)..(287): Xaa at position 287 is Ala or Cys
  MISC_FEATURE (289)..(289): Xaa at position 289 is Lys, Leu, Val, Pro, Glu, Gln, Tyr, Thr, Asp, Phe, Ser, Met, Arg, Trp, Ile, His, Asn, Cys, Gly or Ala
  MISC_FEATURE (291)..(291): Xaa at position 291 is Glu or Gln
  MISC_FEATURE (292)..(292): Xaa at position 292 is Arg or Gln
  MISC_FEATURE (293)..(293): Xaa at position 293 is Arg, Glu or Gln
  MISC_FEATURE (294)..(294): Xaa at position 294 is Val or Ala
  MISC_FEATURE (296)..(296): Xaa at position 296 is Leu or Ile
  MISC_FEATURE (297)..(297): Xaa at position 297 is Glu or Gln
  MISC_FEATURE (298)..(298): Xaa at position 298 is Asp or Gln
  MISC_FEATURE (300)..(300): Xaa at position 300 is Phe or Tyr
  MISC_FEATURE (302)..(302): Xaa at position 302 is Glu or Gln
  MISC_FEATURE (303)..(303): Xaa at position 303 is Phe or Tyr
  MISC_FEATURE (305)..(305): Xaa at position 305 is Lys, Gln, Ala, Ile, Met, Asn, Thr or Val
  MISC_FEATURE (306)..(306): Xaa at position 306 is Gln or Lys
  MISC_FEATURE (309)..(309): Xaa at position 309 is Gln, Lys or Glu
  MISC_FEATURE (313)..(313): Xaa at position 313 is Lys, Gln or Arg
  MISC_FEATURE (316)..(316): Xaa at position 316 is Lys or Gln
  MISC_FEATURE (328)..(328): Xaa at position 328 is Lys, Glu or Gln
  MISC_FEATURE (331)..(331): Xaa at position 331 is Glu, Asn or Gln
  MISC_FEATURE (333)..(333): Xaa at position 333 is Ser, Arg, Gly, Lys, Val, Asn, Ala, His, Gln, Thr, Asp, Ile, Leu, Cys or Glu
  MISC_FEATURE (334)..(334): Xaa at position 334 is Gly, Arg, Lys, Ile or Trp
  MISC_FEATURE (335)..(335): Xaa at position 335 is Ser or Ala
  MISC_FEATURE (336)..(336): Xaa at position 336 is Gly or Ala
  MISC_FEATURE (337)..(337): Xaa at position 337 is Ala, Val or Gly
  MISC_FEATURE (338)..(338): Xaa at position 338 is Ser, His, Val, Lys, Ala, Gly, Thr, Ile, Glu, Met, Arg, Pro, Asp, Asn or Leu
  MISC_FEATURE (339)..(339): Xaa at position 339 is Glu, Asn, Gln, Ile, Pro, Met, Ser, Ala, Cys, Phe, Val, Leu, Asp, Trp, His or Arg
  MISC_FEATURE (341)..(341): Xaa at position 341 is Leu or Val
  MISC_FEATURE (342)..(342): Xaa at position 342 is Ala, Ser or Val
  MISC_FEATURE (343)..(343): Xaa at position 343 is Val or Ile
  MISC_FEATURE (344)..(344): Xaa at position 344 is Phe or Trp
  MISC_FEATURE (345)..(345): Xaa at position 345 is Asn or His
  MISC_FEATURE (346)..(346): Xaa at position 346 is Pro or Ala
  MISC_FEATURE (350)..(350): Xaa at position 350 is Asn or Ser
  MISC_FEATURE (351)..(351): Xaa at position 351 is Gly or Val
  MISC_FEATURE (354)..(354): Xaa at position 354 is Met or Leu
  MISC_FEATURE (355)..(355): Xaa at position 355 is Val, Ile or Leu
  MISC_FEATURE (359)..(359): Xaa at position 359 is Gly or Ala
  MISC_FEATURE (362)..(362): Xaa at position 362 is Asn or Ser
  MISC_FEATURE (364)..(364): Xaa at position 364 is Ala or Ser
  MISC_FEATURE (371)..(371): Xaa at position 371 is Ala, Gly or Thr
  MISC_FEATURE (374)..(374): Xaa at position 374 is Phe or Ile
  MISC_FEATURE (375)..(375): Xaa at position 375 is Lys or Arg
  MISC_FEATURE (380)..(380): Xaa at position 380 is Leu or Gly
  MISC_FEATURE (382)..(382): Xaa at position 382 is Val, Asp or Leu
  MISC_FEATURE (383)..(383): Xaa at position 383 is Leu, Ile or Val
  MISC_FEATURE (384)..(384): Xaa at position 384 is Lys, Ala or G
  MISC_FEATURE (384)..(384): Xaa at position 384 is Lys, Ala or Gly
  MISC_FEATURE (385)..(385): Xaa at position 385 is Ala or Gly
  MISC_FEATURE (389)..(389): Xaa at position 389 is Trp or Tyr
  MISC_FEATURE (391)..(391): Xaa at position 391 is Arg, Leu, Glu, Gln, Asp or His
  MISC_FEATURE (395)..(395): Xaa at position 395 is Asp or Cys
  MISC_FEATURE (396)..(396): Xaa at position 396 is Ala, Leu, Lys, Asn, Gly, Ile, Met, Arg, Tyr, Gln, His or Thr
  MISC_FEATURE (397)..(397): Xaa at position 397 is Gly, Arg or Ala
  MISC_FEATURE (398)..(398): Xaa at position 398 is Ser, Gln or Cys
  MISC_FEATURE (401)..(401): Xaa at position 401 is Ser, His, Pro, Gly, Lys, Val, Arg, Ile, Asn, Phe, Thr, Ala, Asp, Met, Gln or Glu
  MISC_FEATURE (402)..(402): Xaa at position 402 is Lys, Phe, His, Arg, Trp, Gly, Asn, Leu, Tyr, Thr, Val, Met, Pro or Ala
  MISC_FEATURE (403)..(403): Xaa at position 403 is Asp, Tyr, Trp, Phe or Glu
  MISC_FEATURE (405)..(405): Xaa at position 405 is Ala or Ser
  MISC_FEATURE (409)..(409): Xaa at position 409 is Ala or Pro
  MISC_FEATURE (410)..(410): Xaa at position 410 is Ile or Val
  MISC_FEATURE (411)..(411): Xaa at position 411 is Pro or Ala
  MISC_FEATURE (412)..(412): Xaa at position 412 is Pro or Ala
  MISC_FEATURE (416)..(416): Xaa at position 416 is Arg, Glu or Gln
  MISC_FEATURE (417)..(417): Xaa at position 417 is Ala, Ser or Cys
  MISC_FEATURE (418)..(418): Xaa at position 418 is Leu or Met
  MISC_FEATURE (422)..(422): Xaa at position 422 is Met or Val
  MISC_FEATURE (426)..(426): Xaa at position 426 is Thr or Ser
  MISC_FEATURE (436)..(436): Xaa at position 436 is Asp or Lys
  MISC_FEATURE (437)..(437): Xaa at position 437 is Tyr or Val
  MISC_FEATURE (438)..(438): Xaa at position 438 is Val or Arg
  MISC_FEATURE (440)..(440): Xaa at position 440 is Val or Leu
  MISC_FEATURE (442)..(442): Xaa at position 442 is Gln, Lys or Glu
  MISC_FEATURE (445)..(445): Xaa at position 445 is Cys, Leu or Thr
  MISC_FEATURE (447)..(447): Xaa at position 447 is Asp, Lys, Tyr, Ser, Glu, Ile, Gly, Pro, Leu, Phe, Trp or Thr
  MISC_FEATURE (448)..(448): Xaa at position 448 is Val or Ala
  MISC_FEATURE (449)..(449): Xaa at position 449 is Gln or Glu
  MISC_FEATURE (452)..(452): Xaa at position 452 is Gln, Lys or Glu
  MISC_FEATURE (453)..(453): Xaa at position 453 is Asn or Asp
  MISC_FEATURE (454)..(454): Xaa at position 454 is Arg, Tyr, Met, Ser, Val, Ile, Lys, Phe, Trp, Gln, Gly, His, Asp, Leu, Thr, Pro or Asn
  MISC_FEATURE (455)..(455): Xaa at position 455 is Val or Ile
  MISC_FEATURE (457)..(457): Xaa at position 457 is Trp or Asn
  MISC_FEATURE (459)..(459): Xaa at position 459 is Lys, Met, Val, Trp, Gln, Ile, Thr, Ser, His, Cys, Tyr, Pro, Asn, Ala, Arg or Glu
  MISC_FEATURE (460)..(460): Xaa at position 460 is Gly or Ala
  MISC_FEATURE (461)..(461): Xaa at position 461 is Thr or Ser
  MISC_FEATURE (462)..(462): Xaa at position 462 is Gly or Ala
  MISC_FEATURE (463)..(463): Xaa at position 463 is Ala, Ser or Gly
  MISC_FEATURE (464)..(464): Xaa at position 464 is Arg, Gly, His, Gln, Thr, Phe, Ala, Asp, Ser or Lys
  MISC_FEATURE (465)..(465): Xaa at position 465 is Lys, Asn, Val, Met, Pro, Gly, Arg, Thr, His, Cys, Trp, Phe, Ala or Leu
  MISC_FEATURE (466)..(466): Xaa at position 466 is Asp or Arg
  MISC_FEATURE (471)..(471): Xaa at position 471 is Gln, Lys, Glu or Met
  MISC_FEATURE (472)..(472): Xaa at position 472 is Pro or Ser
  MISC_FEATURE (497)..(497): Xaa at position 497 is Asp or Gln
  MISC_FEATURE (499)..(499): Xaa at position 499 is Glu or Gln
  MISC_FEATURE (500)..(500): Xaa at position 500 is Arg, Gln or Lys
  MISC_FEATURE (502)..(502): Xaa at position 502 is Arg, Glu or Gln
  MISC_FEATURE (509)..(509): Xaa at position 509 is Lys, Gln, Glu or Ala
  MISC_FEATURE (517)..(517): Xaa at position 517 is Gln, Cys, Asn, Val or Pro
  MISC_FEATURE (518)..(518): Xaa at position 518 is Glu or Gln
  MISC_FEATURE (520)..(520): Xaa at position 520 is Lys, Gln, Glu, His or Ala
  MISC_FEATURE (525)..(525): Xaa at position 525 is Gln or Lys
  MISC_FEATURE (527)..(527): Xaa at position 527 is Gln, Lys, Pro, Cys, Glu, Ser, His, Phe or Trp
MXSAANAGXLGNLXGXTSXGMXYXVNGLYASPESLXGQPLFXXGGXLDSXXIEGXXXXFPXSMHVHTYFHSDXXQXVSXXIXXXRXXXSXHVGXSGXXXLFSXSXSVDXTTXXQQLXEITXSSTREXHVLWYISLPGAATLXSMLXXXXXXDXXXPNMXAMXLFXXXGPXXXXXAAVGGRLXXXXASKXLXMXSSXSLSTTXXXSXXAXXGEIXIXHGSXMEKQVNSFXXXSTIRXTATGGKPGXTXRILHGPDSXXAFSXWAXSLLXYATLMDFXTXSLXXIXALXDXPXXXXEXXXAXPXXMXXSQXSIPXVDXVLLMDARPPMVXAGXDXXXXXXXDXXXXXXSTSXXYKXXGQFXQRXHXSVADGHXPIXXDLFDXGXXXXPVGXQXVWDXXXXGKXXXYXCWRXXXXQGYXXXGDVXMLAXSGYNPPNLPXXXCXHXSLXAXXXTLXXXXWXDXXXXXXXXVSLWXXGAAGAVASSCFAGVPNYNNPPNSGXIXXLXGSIACVXTSAIASMXXMXSMLSXHXGMEAMMSKL

SEQ ID NO: 4 - protein, 536 aa, Artificial Sequence
  PHI-4 polypeptide variant
  MISC_FEATURE (2)..(2): Xaa at position 2 is Ala or Arg
  MISC_FEATURE (24)..(24): Xaa at position 24 is Asp or Asn
  MISC_FEATURE (42)..(42): Xaa at position 42 is Asp or Asn
  MISC_FEATURE (43)..(43): Xaa at position 43 is Phe or Glu
  MISC_FEATURE (46)..(46): Xaa at position 46 is Glu or Asn
  MISC_FEATURE (74)..(74): Xaa at position 74 is Lys, Glu or Gly
  MISC_FEATURE (79)..(79): Xaa at position 79 is Lys or Glu
  MISC_FEATURE (82)..(82): Xaa at position 82 is Glu, Ile, Leu or Tyr
  MISC_FEATURE (97)..(97): Xaa at position 97 is Arg, Asn, Asp, Glu, Gln, Gly, Ser, Ile, Phe, His, Lys, Thr, Asn, Tyr, Trp, Pro, Cys, Ala, Met, Val or Leu
  MISC_FEATURE (98)..(98): Xaa at position 98 is Tyr or Phe
  MISC_FEATURE (99)..(99): Xaa at position 99 is Lys, Leu, Tyr, Ile or Met
  MISC_FEATURE (109)..(109): Xaa at position 109 is Phe, Lys, Gly, Met, Ser, Asp or Asn
  MISC_FEATURE (147)..(147): Xaa at position 147 is Arg or Glu
  MISC_FEATURE (148)..(148): Xaa at position 148 is Asp, Phe or Pro
  MISC_FEATURE (150)..(150): Xaa at position 150 is Arg, Gln, Glu or Asn
  MISC_FEATURE (151)..(151): Xaa at position 151 is Asp, Ser, Ala or Asn
  MISC_FEATURE (153)..(153): Xaa at position 153 is Leu or Ile
  MISC_FEATURE (162)..(162): Xaa at position 162 is Glu, Asp, Gln, Asn or Leu
  MISC_FEATURE (165)..(165): Xaa at position 165 is Lys, Glu or Gln
  MISC_FEATURE (166)..(166): Xaa at position 166 is Arg or Gln
  MISC_FEATURE (171)..(171): Xaa at position 171 is Tyr or Phe
  MISC_FEATURE (174)..(174): Xaa at position 174 is Glu, Gln, Asn, Lys, Val or Ser
  MISC_FEATURE (182)..(182): Xaa at position 182 is Asp or Gln
  MISC_FEATURE (196)..(196): Xaa at position 196 is Gln, Lys, Asn or Asp
  MISC_FEATURE (203)..(203): Xaa at position 203 is Glu, Thr or His
  MISC_FEATURE (206)..(206): Xaa at position 206 is Tyr or Phe
  MISC_FEATURE (216)..(216): Xaa at position 216 is Glu or Gln
  MISC_FEATURE (220)..(220): Xaa at position 220 is Glu, His, Asp, Thr, Tyr, Val, Ser or Gln
  MISC_FEATURE (247)..(247): Xaa at position 247 is Asp or Tyr
  MISC_FEATURE (256)..(256): Xaa at position 256 is Gln or Lys
  MISC_FEATURE (257)..(257): Xaa at position 257 is Gln or Ile
  MISC_FEATURE (261)..(261): ; Xaa at position 261 is Gln, Glu, Lys or Ala
  MISC_FEATURE (278)..(278): Xaa at position 278 is Glu or Asn
  MISC_FEATURE (281)..(281): Xaa at position 281 is Gln, Lys or Glu
  MISC_FEATURE (289)..(289): Xaa at position 289 is Lys, Leu, Val, Pro, Glu, Gln, Tyr, Thr or Asp
  MISC_FEATURE (293)..(293): Xaa at position 293 is Arg, Glu or Gln
  MISC_FEATURE (313)..(313): Xaa at position 313 is Lys or Gln
  MISC_FEATURE (328)..(328): Xaa at position 328 is Lys, Glu or Gln
  MISC_FEATURE (333)..(333): Xaa at position 333 is Ser, Gly, Lys, Val or Asn
  MISC_FEATURE (334)..(334): Xaa at position 334 is Gly, Arg, Lys or Ile
  MISC_FEATURE (336)..(336): Xaa at position 336 is Gly or Ala
  MISC_FEATURE (338)..(338): Xaa at position 338 is Ser, His, Val, Lys or Ala
  MISC_FEATURE (339)..(339): Xaa at position 339 is Glu, Asn, Ile or Pro
  MISC_FEATURE (343)..(343): Xaa at position 343 is Val or Ile
  MISC_FEATURE (346)..(346): Xaa at position 346 is Pro or Ala
  MISC_FEATURE (355)..(355): Xaa at position 355 is Val or Ile
  MISC_FEATURE (359)..(359): Xaa at position 359 is Gly or Ala
  MISC_FEATURE (391)..(391): Xaa at position 391 is Arg, Leu, Glu, Gln, Asp or His
  MISC_FEATURE (396)..(396): Xaa at position 396 is Ala, Leu, Lys, Asn, Gly or Thr
  MISC_FEATURE (401)..(401): Xaa at position 401 is Ser, His, Pro, Gly, Lys, Val or Arg
  MISC_FEATURE (402)..(402): Xaa at position 402 is Lys, Phe, His, Arg, Gly, Trp, Thr, Asn, Tyr or Met
  MISC_FEATURE (403)..(403): Xaa at position 403 is Asp or Tyr
  MISC_FEATURE (411)..(411): Xaa at position 411 is Pro or Ala
  MISC_FEATURE (412)..(412): Xaa at position 412 is Pro or Ala
  MISC_FEATURE (416)..(416): Xaa at position 416 is Arg or Glu
  MISC_FEATURE (417)..(417): Xaa at position 417 is Ala or Ser
  MISC_FEATURE (418)..(418): Xaa at position 418 is Leu or Met
  MISC_FEATURE (426)..(426): Xaa at position 426 is Thr or Ser
  MISC_FEATURE (440)..(440): Xaa at position 440 is Val or Leu
  MISC_FEATURE (447)..(447): Xaa at position 447 is Asp, Lys, Tyr, Ser, Glu or Ile
  MISC_FEATURE (452)..(452): Xaa at position 452 is Gln, Lys or Glu
  MISC_FEATURE (454)..(454): Xaa at position 454 is Arg, Tyr, Met, Ser, Val, Ile, Lys, Phe, Trp or Gln
  MISC_FEATURE (455)..(455): Xaa at position 455 is Val or Ile
  MISC_FEATURE (459)..(459): Xaa at position 459 is Lys, Met, Val, Trp, Gln, Ile or Tyr
  MISC_FEATURE (461)..(461): Xaa at position 461 is Thr or Ser
  MISC_FEATURE (462)..(462): Xaa at position 462 is Gly or Ala
  MISC_FEATURE (463)..(463): Xaa at position 463 is Ala or Ser
  MISC_FEATURE (464)..(464): Xaa at position 464 is Arg, Gly, His, Ala, Asp, Ser or Lys
  MISC_FEATURE (465)..(465): Xaa at position 465 is Lys, Asn, Val, Met, Pro, Gly or Arg
  MISC_FEATURE (471)..(471): Xaa at position 471 is Gln, Lys, Glu or Met
  MISC_FEATURE (472)..(472): Xaa at position 472 is Pro or Ser
  MISC_FEATURE (500)..(500): Xaa at position 500 is Arg or Gln
  MISC_FEATURE (509)..(509): Xaa at position 509 is Lys, Gln or Ala
  MISC_FEATURE (520)..(520): Xaa at position 520 is Lys, Gln, Glu, His or Ala
  MISC_FEATURE (527)..(527): Xaa at position 527 is Gln, Lys, Pro, Cys or Glu
MXSAANAGQLGNLPGVTSMGMGYXVNGLYASPESLLGQPLFXXGGXLDSIEIEGRSYTFPRSMHVHTYFHSDFXQDVSXEIXEYREKMSQHVGVSGXXXLFSASLSVDXTTTDQQLTEITYSSTREAHVLWYISLPGAATLRSMLRXXFXXDXNNPNMPAMXLFXXYGPYXISXAAVGGRLXYSAASKTLKMDSSXSLSTTAXMSXKALVGEIKIXHGSXMEKQVNSFRSNSTIRLTATGGKPGMTXRILHGPDSXXAFSXWAESLLDYATLMDFSTXSLXPIWALADXPERXVELEDAFPEFMKQSQQSIPXVDKVLLMDARPPMVXAGEDXXSXAXXDLAXFNXSTSNGYKMXGQFXQRNHASVADGHAPIFKDLFDLGVLKAPVGWQXVWDDXGSGKXXXYACWRAIXXQGYXXXGDVMMLAXSGYNPPNLPDYVCXHQSLCAXVQTLXNXXWWDXGXXXXXDVSLWXXGAAGAVASSCFAGVPNYNNPPNSGDIEXLRGSIACVXTSAIASMQEMXSMLSQHXGMEAMMSKL

SEQ ID NO: 5 - DNA, 2805 bp, Artificial Sequence
  PHI-4 polypeptide variant fusion protein
atgcaccatcaccatcaccataaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattaggcatgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaaggattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 6 - protein, 934 aa, Artificial Sequence
  PHI-4 polypeptide variant fusion protein
MHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGMRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 7 - DNA, 2805 bp, Artificial Sequence
  PHI-4 polypeptide variant fusion protein
atgcaccatcaccatcaccataaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattaggcatgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaaggattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 8 - protein, 934 aa, Artificial Sequence
  PHI-4 polypeptide variant fusion protein
MHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGMRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 9 - DNA, 2805 bp, Artificial Sequence
  PHI-4 polypeptide variant fusion protein
atgcaccatcaccatcaccataaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattaggcatgcggtctgcggcgaatgcaggccaactgggtaacttgcctggcgtcacgagcatgggcatgggttacgacgtgaacggtctgtatgcgagcccggaatccctgttgggccaaccgatttttgatttcggtggtgagctggacagcatcgaaatcgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgcttcaagctgttcagcgcttctttgtctgtcgattttaccacgactgaccaacaattgaccgagattacctacagcagcacccgcgaggcgcatgtgctgtggtatattagcctgccgggtgccgctactctgcgtagcatggtgcgtcgcgacttccgtgatgatttgaacaatccgaatatgccggccatggaggtgtttaagcgttacggcccgtactaccttagtgaggcggcagtcggcggtcgcctggactactctgcagcgagcaaaaccctgaagatggattccagccagtctctgagcactacggccgaaatgagctataaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatctgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgattggccagtttgggcaacgcaaccatgctagcgtggcagacggccacgctccgatcttcaaggacctgttcgatctgggtgttttgaaagccccggtgggctggcagcgtgtgtgggacgacgcaggctccggtaagagcaaggattacgcatgttggcgtgccatcccagcacaaggttaccgtgccttgggtgacgtgatgatgctggctactagcggctacaatccacctaatctgccggactatgtttgcgtgcaccagtccctgtgcgccgacgtccagacgctgcagaaccgcgtgtggtgggataagggtactggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 10 - protein, 934 aa, Artificial Sequence
  PHI-4 polypeptide variant fusion protein
MHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGMRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 11 - DNA, 2805 bp, Artificial Sequence
  PHI-4 polypeptide variant fusion protein
atgcaccatcaccatcaccataaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattaggcatgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 12 - protein, 934 aa, Artificial Sequence
  PHI-4 polypeptide variant fusion protein
MHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGMRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 13 - DNA, 34 bp, Artificial Sequence
  mutagenesis primer
cgtgggtgtcagcggtgattatctgctgttcagc

SEQ ID NO: 14 - DNA, 34 bp, Artificial Sequence
  mutagenesis primer
gctgaacagcagataatcaccgctgacacccacg

SEQ ID NO: 15 - DNA, 51 bp, Artificial Sequence
  mutagenesis primer
  misc_feature (25)..(26): n is a, c, g, or t
  misc_feature (27)..(27): k is g or t
ggctggcagcgtgtgtgggacgacnnkggctccggtaagagcaaggattac

SEQ ID NO: 16 - DNA, 24 bp, Artificial Sequence
  mutagenesis primer
caccggggctttcaaaacacccag

SEQ ID NO: 17 - DNA, 24 bp, Artificial Sequence
  mutagenesis primer
ggctggcagcgtgtgtgggacgac

SEQ ID NO: 18 - DNA, 21 bp, Artificial Sequence
  mutagenesis primer
gcactggcggatctgccagag

SEQ ID NO: 19 - DNA, 21 bp, Artificial Sequence
  mutagenesis primer
gttgcgtctagctgttttgcc

SEQ ID NO: 20 - DNA, 21 bp, Artificial Sequence
  mutagenesis primer
ctctggcagatccgccagtgc

SEQ ID NO: 21 - DNA, 21 bp, Artificial Sequence
  mutagenesis primer
ggcaaaacagctagacgcaac

SEQ ID NO: 22 - DNA, 1611 bp, Artificial Sequence
  mAXMI-205 polypeptide variant
atggcttcagcagcaaatgcaggtcagcttggcaacctccccggcgttacttcgatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggccgctacaagttgttcagcgcttcgctgagcgtggatttcaccaccacggaccagcaactgaccgagattacctacagctccacccgcgaagcccacgtgctgtggtacatcagcctgcctggcgcggccacgctgcgttcgatgctgcgccgcgatttccgcgacgacctgaacaaccccaatatgccggcgatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatggttggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccgccgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatgaagtccatgctcagccagcaccaaggcatggaagcgatgatgtccaagctgtga

SEQ ID NO: 23 - DNA, 1611 bp, Artificial Sequence
  codon optimized
atgcgctcagcagcaaatgcaggtcagcttggcaacctccccggcgttacttcgatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggccgcttcaagttgttcagcgcttcgctgagcgtggatttcaccaccacggaccagcaactgaccgagattacctacagctcaacccgcgaagcccatgtgctgtggtacatcagcctgcctggcgcggccacgctgcgttcgatgctgcgccgcgatttccgcgacgacatcaacaaccccaatatgccggcgatggagctgttcaagcgctatggtccctactacctctcggaagcggcggtgggcggccggctggactacagcgcggccagcaagaccttgaagatggacagcagccagtcgctgtccaccaccgccgaaatgtccttcaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatgatcggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccggcgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatgaagtccatgctcagccagcaccaaggcatggaagcgatgatgtccaagctgtga

SEQ ID NO: 24 - DNA, 1611 bp, Artificial Sequence
  codon optimized
atgcgctcagcagcaaatgcaggtcagcttggcaacctccccggcgttacttcgatgggcatgggctatgacgtgaatggtttgtacgccagcccggaaagcctgcttggccaacccatcttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggccgcttcaagttgttcagcgcttcgctgagcgtggatttcaccaccacggaccagcaactgaccgagattacctacagctcaacccgcgaagcccatgtgctgtggtacatcagcctgcctggcgcggccacgctgcgttcgatggtgcgccgcgatttccgcgacgacctgaacaaccccaatatgccggcgatggaggtgttcaagcgctatggtccctactacctatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatgatcggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccggcgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatgaagtccatgctcagccagcaccaaggcatggaagcgatgatgtccaagctgtga

SEQ ID NO: 25 - DNA, 1611 bp, Artificial Sequence
  codon optimized
atgcgctcagcagcaaatgcaggtcagcttggcaacctccccggcgttacttcgatgggcatgggctatgacgtgaatggtttgtacgccagcccggaaagcctgcttggccaacccttgttcaacttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggccgcttcaagttgttcagcgcttcgctgagcgtggatttcaccaccacggaccagcaactgaccgagattacctacagctccacccgcgaagcccacgtgctgtggtacatcagcctgcctggcgcggccacgctgcgttcgatgctgcgccgcgatttccgcgacgacatcaacaaccccaatatgccggcgatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctgtcggtgttcaatcccagcacctccaatggctacaagatgatcggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccggcgcagggctaccgcgcgctgggcgatgtgatgatgctggccagcagcggctataacccgccgaatctgccggactatgtttgcgtgcaccaaagcctgtgcgcggatgtgcagacgctgcaaaaccgggtgtggtgggacaagggcagcggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatgaagtccatgctcagccagcaccaaggcatggaagcgatgatgtccaagctgtga

SEQ ID NO: 26 - DNA, 1611 bp, Artificial Sequence
  codon optimized
atggcttcagcagcaaatgcaggtcagcttggcaacctccccggcgttacttcgatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggcgactacaagttgttcagcgcttcgctgagcgtggataagaccaccacggaccagcaactgaccgagattacctacagctccacccgcgaagcccacgtgctgtggtacatcagcctgcctggcgcggccacgctgcgttcgatgctgcgccgcgatttccgcgacgacctgaacaaccccaatatgccggcgatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatggttggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccgccgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatggagtccatgctcagccagcaccaaggcatggaagcgatgatgtccaagctgtga

SEQ ID NO: 27 - DNA, 2811 bp, Artificial Sequence
  PHI-4 polypeptide variant fusion protein codon optimized
atgaagatcgaggagggcaagctggtgatctggatcaacggcgacaagggctacaacggcctggcggaagtgggcaagaagttcgagaaggacaccggcatcaaggtcaccgtggagcacccggacaagctggaggagaagttcccgcaggtggcagcgactggcgatggcccggacatcatcttctgggcacacgaccgcttcggaggctacgcgcagagcggcctgctggcagagatcaccccggacaaggcgttccaggacaagctgtacccgttcacctgggacgcggtgcgctacaacggcaagctgatcgcgtacccgatcgcggtggaggccctgagcctgatctacaacaaggacctgctgccgaacccgccgaagacctgggaggagatccctgcgctggacaaggagctgaaggcgaagggcaagagcgcgctgatgttcaacctgcaggagccgtacttcacctggccgctgatcgcagcggatggcggctacgcgttcaagtacgagaacgggaagtacgacatcaaggacgtcggcgtggacaacgctggcgcgaaggcgggcctgaccttcctcgtggacctgatcaagaacaagcacatgaacgcggacaccgactacagcatcgcggaggcggcgttcaacaagggcgagaccgcgatgaccatcaacggcccgtgggcgtggagcaacatcgacaccagcaaggtgaactacggcgtgaccgtgctgccgaccttcaagggccagccgagcaagccgttcgtgggagtgctgagcgctggcatcaacgcggcgagcccgaacaaggagctggcgaaggagttcctggagaactacctgctcaccgacgaaggcctggaggcggtgaacaaggacaagccgctgggagcggtggcgctgaagagctacgaggaggagctggtgaaggacccgcgcatcgcggcgactatggagaacgcgcagaagggcgagatcatgccgaacatcccgcagatgagcgcgttctggtacgcggtgcgcacagcggtgatcaacgcggcgtcaggccgccagaccgtggacgaagcgctgaaggacgctcagaccaacagctcctcgaacaacaacaacaacaacaacaacaacaacctgggcgacgacgacgacaaggtgccgcacatgagcatgggcggtcgcgacatcgtcgacgcttcagcagcaaatgcaggtcagcttggcaacctccccggcgttacttcgatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggccgctacaagttgttcagcgcttcgctgagcgtggatttcaccaccacggaccagcaactgaccgagattacctacagctccacccgcgaagcccacgtgctgtggtacatcagcctgcctggcgcggccacgctgcgttcgatgctgcgccgcgatttccgcgacgacctgaacaaccccaatatgccggcgatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatggttggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccgccgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatgaagtccatgctcagccagcaccaaggcatggaagcgatgatgtccaagctgtga

SEQ ID NO: 28 - DNA, 2811 bp, Artificial Sequence
  PHI-4 polypeptide variant fusion protein codon optimized
atgaagatcgaggagggcaagctggtgatctggatcaacggcgacaagggctacaacggcctggcggaagtgggcaagaagttcgagaaggacaccggcatcaaggtcaccgtggagcacccggacaagctggaggagaagttcccgcaggtggcagcgactggcgatggcccggacatcatcttctgggcacacgaccgcttcggaggctacgcgcagagcggcctgctggcagagatcaccccggacaaggcgttccaggacaagctgtacccgttcacctgggacgcggtgcgctacaacggcaagctgatcgcgtacccgatcgcggtggaggccctgagcctgatctacaacaaggacctgctgccgaacccgccgaagacctgggaggagatccctgcgctggacaaggagctgaaggcgaagggcaagagcgcgctgatgttcaacctgcaggagccgtacttcacctggccgctgatcgcagcggatggcggctacgcgttcaagtacgagaacgggaagtacgacatcaaggacgtcggcgtggacaacgctggcgcgaaggcgggcctgaccttcctcgtggacctgatcaagaacaagcacatgaacgcggacaccgactacagcatcgcggaggcggcgttcaacaagggcgagaccgcgatgaccatcaacggcccgtgggcgtggagcaacatcgacaccagcaaggtgaactacggcgtgaccgtgctgccgaccttcaagggccagccgagcaagccgttcgtgggagtgctgagcgctggcatcaacgcggcgagcccgaacaaggagctggcgaaggagttcctggagaactacctgctcaccgacgaaggcctggaggcggtgaacaaggacaagccgctgggagcggtggcgctgaagagctacgaggaggagctggtgaaggacccgcgcatcgcggcgactatggagaacgcgcagaagggcgagatcatgccgaacatcccgcagatgagcgcgttctggtacgcggtgcgcacagcggtgatcaacgcggcgtcaggccgccagaccgtggacgaagcgctgaaggacgctcagaccaacagctcctcgaacaacaacaacaacaacaacaacaacaacctgggcgacgacgacgacaaggtgccgcacatgagcatgggcggtcgcgacatcgtcgacgcttcagcagcaaatgcaggtcagcttggcaacctccccggcgttacttcgatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggcgactacaagttgttcagcgcttcgctgagcgtggataagaccaccacggaccagcaactgaccgagattacctacagctccacccgcgaagcccacgtgctgtggtacatcagcctgcctggcgcggccacgctgcgttcgatgctgcgccgcgatttccgcgacgacctgaacaaccccaatatgccggcgatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatggttggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccgccgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatggagtccatgctcagccagcaccaaggcatggaagcgatgatgtccaagctgtga

SEQ ID NO: 29 - DNA, 2811 bp, Artificial Sequence; identical to SEQ ID NO: 27
  PHI-4 polypeptide variant fusion protein codon optimized

SEQ ID NO: 30 - DNA, 2805 bp, Artificial Sequence
  PHI-4 polypeptide variant fusion protein codon optimized
atgcaccatcaccatcaccataaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattaggcatgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcacaaggattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 31 - protein, 934 aa, Artificial Sequence
  PHI-4 polypeptide variant fusion protein codon optimized
MHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGMRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 32 - DNA, 25 bp, Artificial Sequence
  mutagenesis primer
ttaggcatgcgcaatgacaaaaccg

SEQ ID NO: 33 - DNA, 24 bp, Artificial Sequence
  mutagenesis primer
agaggatccctacttccagccagc

SEQ ID NO: 34 - DNA, 1608 bp, Chromobacterium sp.
atggcatccgcagcaaatgcaggtcagcttggcaacctccccggcgttacttccatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggccgctacaagttgttcagcgcttcgctgagcgtggatttcaccaccacggaccagcaactgaccgagattacctacagctccacccgcgaagcccatgtgctgtggtacatcagcctgcctggcgcggccacgctgcgttcgatgctgcgccgcgatttccgcgacgacctgaacaaccccaatatgccggccatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcatggctcggagatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacaagcccgagcgccgcgtcgagcttgaggacgccttccccgaattcatgaagcagtcgcagcagtccatccccaaggtggacaaggtgctgctgatggacgcgcggccgcctatggtgaaggctggggaggatagcggctccggcgcgtcggaggatctggctgtgttcaatcccagcacctccaatggctacaagatggttggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagtccaaggactacgcgtgctggcgcgcgattccgccgcagggctaccgcgcgctgggcgatgtgatgatgctggccaccagcggctataacccgccgaatctgccggactatgtttgcgtgcatcaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcatgcgtgaagaccagcgcgatcgcgtccatgcaggaaatgaagtccatgctcagccagcaccaaggcatggaagcgatgatgtccaagctg

SEQ ID NO: 35 - protein, 536 aa, Chromobacterium sp.
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 36 - protein, 526 aa, Artificial Sequence
  AXMI-205 trun10
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQH

SEQ ID NO: 37 - protein, 516 aa, Artificial Sequence
  AXMI-205 trun20
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASM

SEQ ID NO: 38 - protein, 588 aa, Marinomonas sp.
MIMKLNNNFSDFIGRAYDIENGKMASSSSVLLAKEALFDFSQEPTTKVTIGNKSYQLPHVFNWNSGTSSSGTTTIEGSSEVSYLKSISNLFSTQYSGVIFKGSISSTFKSVESNNNNNYFITETRNRSLGTLSFNGDFKDYLSAKARDFINDNDISPVDVFAKYGIYFIKSFEVGGRLSVDAASEQSQYTKQTEFNLEVKAAYKALETENNTEIQKTIKKLASNSSYSFYAEGGDLDIISSQSPSSDEFQLWLKSIASSPTLTWFNNLDDALVPIWTLAKNDKRQAQLKSYYQNKITGGYLRSMYFIAHTRKEGDGYSDPDTNTPSKNVYITCKNYGQKDAASHEFILDQNHMLAGAYNSREVNGTDVYDFSEAIQSLGSKLDSRYLDVTLTCKGEDAWAPDILFMIGEDEGKDFHVLAADTDQTKYLSIEGKDSVETVTISSTITNGAITSGSTDLNGFWLITSTDKDEYSHTDSNDVSVTIELKNKKFPISQNIDIVKRKDRRSNIFDLSASINNNSENIIFEDIKKISIINSSGDDWKLKSAICITRDFSGHFRVLAAHPDLGDNFWIGKDYKKTKEIFPTPDIE

SEQ ID NO: 39 - protein, 5 aa, Artificial Sequence
  receptor motif
  misc_feature (2)..(4): Xaa can be any naturally occurring amino acid
GXXXD

SEQ ID NO: 40 - protein, 9 aa, Artificial Sequence
  receptor motif
  misc_feature (2)..(2): Xaa can be any naturally occurring amino acid
  MISC_FEATURE (4)..(4): Xaa is Ser or Thr
  misc_feature (6)..(8): Xaa can be any naturally occurring amino acid
DXGXGXXXD

SEQ ID NO: 41 - protein, 536 aa, Artificial Sequence
  AXMIevo25
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDASLWQPGAAGAVASSCFAGVPNYNNPPNSGDIERLRGSIACVKTSAIASMQEMKSMLSQHQGMEAMMSKL

SEQ ID NO: 42 - protein, 536 aa, Artificial Sequence
  AXMIevo30
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDLSLWQPGAAGAVASSCFAGVPNYNNPPNSGDIERLRGSIACVKTSAIASMQEMKSMLSQHQGMEAMMSKL

SEQ ID NO: 43 - protein, 536 aa, Artificial Sequence
  AXMevo34
MASAANAGQLGNLPGVTSMGMGYDVNGLYASPESLLGQPLFDFGGELDSIEIEGRSYTFPRSMHVHTYFHSDFKQDVSKEIEEYRTKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 44 - protein, 536 aa, Artificial Sequence
  AXMIevo35
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMREMKSMLSQHQGMEAMMSKL

SEQ ID NO: 45 - protein, 520 aa, Artificial Sequence
  AXMI2a11
MASAANAGQLGNLPGVESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 46 - protein, 536 aa, Artificial Sequence
  AXMI1c1
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDTSLWQPGAAGAVASSCFAGVPNYNNPPNSGDIERLRGSIACVKTSAIASMQEMKSMLSQHQGMEAMMSKL

SEQ ID NO: 47 - protein, 536 aa, Artificial Sequence
  AXMI1a4
MASAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGANKDVSLWQPGAAGAVASSCFAGVPNYNNPPNSGDIERLRGSIACVKTSAIASMQEMKSMLSQHQGMEAMMSKL

SEQ ID NO: 48 - protein, 197 aa, Laccaria bicolor
MANAKVEYRNVTFKQLINNDAGSGASADLSTWRPDLSNGWYYLGPAATNNGNTPGTGIVVRALEPGVLVDVADWIQVWNDAGSGKPTDYALWRGVGPTPDYIVVGGFFTRSHNKPTAQEAKGIKAIHRLALHNTSPGSQVWTDKGSKAKEDGAIWGISSFGVVPTGAFVPVKGYNNPPQELYGLQPQVAKSGLEGEY

SEQ ID NO: 49 - protein, 470 aa, Clavibacter michiganensis
MSDFFVTETDTPRILPGVSLTGSTYDVFGDDATNDSAIFQIFDWSKAEWGTTEINGTEYRIPKLMNAEGVAGSEYVSIYGNTVEEYQQSLAASVAVSGSNMFFSGSLETQFGSSSMRRSENAFSRVEQVVKLWSIGLPPSKKLRELLSGSFLEALDGLPAAASTSEEQAEYKGFLDTWGAFYLSGMLIGGKTLFTSSVNKLTVDRTLSISVTADLSYKSVTGQISNEDKIKYASQLSQFASSSNTVKNAFGGNPALASRVFDGRVQYDEWSASVAQNPVIVRFDGTRPLTGVWTLCSTPERGKILESYFDDKWAPARSLELSHFPDVVDDLTVVVGNDDQPPVPDGYTKDDYDLNRHAGGKFIYLCWHKVPVSGLRKPKRVLQAMQVIYNGDKVPDGYSKINVDLNQGAGGDDVFLCMKQGEYGTDENILDVRVIGGNDSFVPAPYGYKTLPGDLNKGAGGDYVYIAYAN

SEQ ID NO: 50 - protein, 130 aa, Nematostella vectensis
GSGADDDVSIWRPHGAEGFYRLGDYAVASHNKPSNPAALVAKDDGSGALAKPVGYSRVWSDAGSGADRDVSLWKPTAAAGYQCLGLLATSGATPGLDDMRCVWRGLLIQGGSFEVWNDSGSGADKDVGIY

SEQ ID NO: 51 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYEALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 52 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 53 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 54 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 55 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADQPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 56 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFQDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 57 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMQSMLSQHQGMEAMMSKL

SEQ ID NO: 58 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIQHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 59 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYEALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 60 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVQTSAIASMQEMESMLSQHQGMEAMMSKL

SEQ ID NO: 61 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMQLFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 62 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFERYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 63 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGQYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 64 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLREDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 65 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIQHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 66 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDQGTGARKDVSLWQPGAAGAVASSCFAGVPNYNNPPNSGDIERLRGSIACVKTSAIASMQEMESMLSQHQGMEAMMSKL

SEQ ID NO: 67 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 68 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLKNRVWWDKGTGARKDVSLWQPGAAGAVASSCFAGVPNYNNPPNSGDIERLRGSIACVKTSAIASMQEMESMLSQHQGMEAMMSKL

SEQ ID NO: 69 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSHMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 70 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVEAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 71 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIEQLRGSIACVKTSAIASMQEMESMLSQHQGMEAMMSKL

SEQ ID NO: 72 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPEREVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 73 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 74 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 75 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 76 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAAMDVSLWQPGAAGAVASSCFAGVPNYNNPPNSGDIERLRGSIACVKTSAIASMQEMKSMLSQHQGMEAMMSKL

SEQ ID NO: 77 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 78 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAAVEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 79 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 80 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 81 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 82 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAKMDVSLWQPGAAGAVASSCFAGVPNYNNPPNSGDIERLRGSIACVKTSAIASMQEMKSMLSQHQGMEAMMSKL

SEQ ID NO: 83 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 84 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAKKDVSLWQPGAAGAVASSCFAGVPNYNNPPNSGDIERLRGSIACVKTSAIASMQEMKSMLSQHQGMEAMMSKL

SEQ ID NO: 85 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHWDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 86 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 87 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 88 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 89 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 90 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAAVEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 91 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 92 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 93 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 94 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDKGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 95 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHWDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 96 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDKGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 97 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAAKDVSLWQPGAAGAVASSCFAGVPNYNNPPNSGDIERLRGSIACVKTSAIASMQEMKSMLSQHQGMEAMMSKL

SEQ ID NO: 98 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDKGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 99 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAAVNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 100 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 101 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 102 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 103 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 104 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 105 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 106 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 107 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAADMDVSLWQPGAAGAVASSCFAGVPNYNNPPNSGDIERLRGSIACVKTSAIASMQEMKSMLSQHQGMEAMMSKL

SEQ ID NO: 108 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 109 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAADKDVSLWQPGAAGAVASSCFAGVPNYNNPPNSGDIERLRGSIACVKTSAIASMQEMKSMLSQHQGMEAMMSKL

SEQ ID NO: 110 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAAVNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 111 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 112 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 113 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDKGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 114 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 115 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAAVEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 116 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 117 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 118 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMESMLSQHKGMEAMMSKL

SEQ ID NO: 119 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 120 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 121 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 122 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 123 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAAKDVSLWQPGAAGAVASSCFAGVPNYNNPPNSGDIERLRGSIACVKTSAIASMQEMKSMLSQHQGMEAMMSKL

SEQ ID NO: 124 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHWDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 125 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 126 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAAVEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 127 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAKKDVSLWQPGAAGAVASSCFAGVPNYNNPPNSGDIERLRGSIACVKTSAIASMQEMKSMLSQHQGMEAMMSKL

SEQ ID NO: 128 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGWDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 129 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 130 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMESMLSQHKGMEAMMSKL

SEQ ID NO: 131 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 132 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAAVEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 133 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 134 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAKMDVSLWQPGAAGAVASSCFAGVPNYNNPPNSGDIERLRGSIACVKTSAIASMQEMKSMLSQHQGMEAMMSKL

SEQ ID NO: 135 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 136 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDLGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 137 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGWDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 138 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDKGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 139 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAAVNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 140 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAAVNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 141 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGWDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 142 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKGGDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 143 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAADKDVSLWQPGAAGAVASSCFAGVPNYNNPPNSGDIERLRGSIACVKTSAIASMQEMKSMLSQHQGMEAMMSKL

SEQ ID NO: 144 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASNDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 145 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDKGSGKGKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 146 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAADMDVSLWQPGAAGAVASSCFAGVPNYNNPPNSGDIERLRGSIACVKTSAIASMQEMKSMLSQHQGMEAMMSKL

SEQ ID NO: 147 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTAAAMDVSLWQPGAAGAVASSCFAGVPNYNNPPNSGDIERLRGSIACVKTSAIASMQEMKSMLSQHQGMEAMMSKL

SEQ ID NO: 148 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 149 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 150 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 151 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 152 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 153 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 154 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 155 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 156 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 157 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 158 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 159 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 160 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 161 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 162 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSKSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 163 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 164 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 165 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 166 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 167 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 168 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHKGMEAMMSKL

SEQ ID NO: 169 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 170 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 171 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 172 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 173 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 174 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSKSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 175 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 176 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSKSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 177 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 178 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 179 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 180 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHKGMEAMMSKL

SEQ ID NO: 181 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 182 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCAKVQTLQNRVWWDKGTGARKDVSLWQPGAAGAVASSCFAGVPNYNNPPNSGDIERLRGSIACVKTSAIASMQEMESMLSQHKGMEAMMSKL

SEQ ID NO: 183 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 184 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKGKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 185 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 186 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAAVEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 187 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 188 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAAVEDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 189 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAAVEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 190 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAAAKDVSLWQPGAAGAVASSCFAGVPNYNNPPNSGDIERLRGSIACVKTSAIASMQEMESMLSQHQGMEAMMSKL

SEQ ID NO: 191 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 192 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAAVEDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 193 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 194 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKGHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 195 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAAKMDVSLWQPGAAGAVASSCFAGVPNYNNPPNSGDIERLRGSIACVKTSAIASMQEMESMLSQHQGMEAMMSKL

SEQ ID NO: 196 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHWDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 197 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAAVEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 198 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASNDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 199 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAAAMDVSLWQPGAAGAVASSCFAGVPNYNNPPNSGDIERLRGSIACVKTSAIASMQEMESMLSQHQGMEAMMSKL

SEQ ID NO: 200 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHGDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 201 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAARKDVSLWQPGAAGAVASSCFAGVPNYNNPPNSGDIERLRGSIACVKTSAIASMQEMESMLSQHQGMEAMMSKL

SEQ ID NO: 202 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 203 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASNDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 204 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAAKKDVSLWQPGAAGAVASSCFAGVPNYNNPPNSGDIERLRGSIACVKTSAIASMQEMESMLSQHQGMEAMMSKL

SEQ ID NO: 205 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 206 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKGKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 207 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 208 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASNDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 209 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASNDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 210 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVLDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 211 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAADKDVSLWQPGAAGAVASSCFAGVPNYNNPPNSGDIERLRGSIACVKTSAIASMQEMESMLSQHQGMEAMMSKL

SEQ ID NO: 212 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTAADMDVSLWQPGAAGAVASSCFAGVPNYNNPPNSGDIERLRGSIACVKTSAIASMQEMESMLSQHQGMEAMMSKL

SEQ ID NO: 213 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAAVNDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 214 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAAVNDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 215 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKGKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 216 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKGWDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 217 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKGGDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 218 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRSDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 219 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 220 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 221 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSNSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 222 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 223 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 224 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFQQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 225 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 226 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 227 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 228 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 229 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 230 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 231 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 232 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 233 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 234 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 235 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 236 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 237 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 238 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 239 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 240 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 241 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 242 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 243 - protein, 536 aa, Artificial Sequence
  PHI-4 polypeptide variant
MRSAANAGQLGNLPGVTSMGMGYNVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 244 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGRAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 245 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 246 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 247 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 248 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 249 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 250 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 251 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 252 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 253 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 254 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 255 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMESSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 256 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 257 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 258 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADNPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 259 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 260 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQNIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 261 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 262 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 263 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 264 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRGMLRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 265 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAVPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 266 - protein, 536 aa, Artificial Sequence
  PHI-4 polypeptide variant
MRSAANAGQLGNLPGVTSMGMGYNVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 267 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 268 - protein, 536 aa, Artificial Sequence
  PHI-4 polypeptide variant
MRSAANAGQLGNLPGVTSMGMGYDVNGLYASPESLLGQPIFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 269 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 270 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 271 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSRDYACWRAVPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 272 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLDNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 273 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 274 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLDNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 275 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAIFNPSTSNGYKMVGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYSNPPNSGDIERLRGSIACVKTSAIASMQEMKSMLSQHQGMEAMMSKL

SEQ ID NO: 276 - protein, 536 aa, Artificial Sequence
  PHI-4 polypeptide variant
MRSAANAGQLGNLPGVTSMGMGYNVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYISEAAVGGRLDYSAASKTLKMDSSQSLSTTAEMSYKALVGEIKIEHGSEMERQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 277 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 278 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPAQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 279 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDAHPPMVKAGEDSGSGASEDLAVFNASTSNGYKMVGQFAQRNHASVADGHAPIFKDLFDLGVLKAPVGWQRVWDDAGSGKSKDYACWRAIPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQDVKSMLSQHQGMEAMMSKL

SEQ ID NO: 280 - protein, 536 aa, Artificial Sequence
  PHI-4 polypeptide variant
MRSAANAGQLGNLPGVTSMGMGYDVNGLYASPESLLGQPFFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 281 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFNRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 282 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLASSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 283 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADNPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIAAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 284 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 285 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMIKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 286 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRGMLRRDFRDDLNNPNMPAMELFKRYGPYYLSEAAVGGRLDYSAASKTLKMESSQSLSTTAEMSYKALVGEIKIEHGSEMEKQVNSFRSNSTIRLTATGGKPGTTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 287 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAIFNPSTSNGYKMVGQFAQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 288 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAVPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 289 - protein, 536 aa, Artificial Sequence
  PHI-4 polypeptide variant
MRSAANAGQLGNLPGVTSMGMGYNVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDIDNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 290 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFGQRNHASVADGHAPIFKDLFDLGVLKAPVGWQRVWDDAGSGKSRDYACWRAVPAQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 291 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 292 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 293 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 294 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPAQGYRALGDVMMLATSGYNPPNLPDYVCVHQSLCADVQTLRNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 295 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 296 - protein, 536 aa, Artificial Sequence
  PHI-4 polypeptide variant
MRSAANVGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 297 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLVDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 298 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMESSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 299 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 300 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAVPPQGYRAMGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 301 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 302 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 303 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 304 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 305 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGATTLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAIFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 306 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 307 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPPQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMETMMSKL

SEQ ID NO: 308 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPPQGYRALGDVMMLASSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 309 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 310 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIAPQGYRAMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 311 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASLQEMKSMLSQHQGMEAMMSKL

SEQ ID NO: 312 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPAQGYRSLGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 313 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGAPNYNNPPNSGDIERLRGSIACVKTSAIASMQEMKSMLSQHQGMEAMMSKL

SEQ ID NO: 314 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 315 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 316 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMIGQFGQRNHASVADGHAPIFKDLFDLGVLKAPVGWQRVWDDAGSSKSKDYACWRAIPPQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 317 - protein, 536 aa, Artificial Sequence
  PHI-4 polypeptide variant
MRSAANAGQLGNLPGVTSMGMGYNVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 318 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 319 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 320 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFAQRNHASVADGHAPIFKDLFDLGVLKAPVGWQRVWDDAGSGKSKDYACWRAIPPQGYRAMGDLMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 321 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 322 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 323 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFAQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 324 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 325 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRGMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 326 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 327 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPPQGYRSLGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 328 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAIFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 329 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSRDYACWRAVPPQGYRAMGDVMMLATSGYNPPNLPDYACVHQSLCADVQTLQNRVWWDKGTGARKDVSLWQPGAAGAVASSCFAGVPNYNNPPNSGDIERLRGSIACVKTTAIASMQEMKSMLSQHQGMEAMMSKL

SEQ ID NO: 330 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 331 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMIGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 332 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFAQRNHASVADGHAPIFKDLFDLGVLKAPVGWQRVWDDAGSGKSKDYACWRAVPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 333 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRIWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 334 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAVPAQGYRALGDVMMLASSGYNPPNLLDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 335 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSKSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 336 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMIGQFGQRNHASVADGHAPIFKDLFDLGVLKAPVGWQRVWDDAGSGKSKDYACWRAIPAQGYRAMGDVMMLASSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 337 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 338 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSIFNPSTSNGYKMVGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 339 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 340 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAVPAQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 341 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLDNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 342 - protein, 536 aa, Artificial Sequence
  PHI-4 polypeptide variant
MRSAANAGQLGNLPGVTSMGMGYNVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 343 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVTMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 344 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMVGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 345 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITFSSTREAHVLWYLSLPGAATLRGMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 346 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQNIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 347 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFAQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 348 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMVGQFAQRNHASVADGHAPIFKDLFDLGVLKAPVGWQRVWDDAGSGKSKDYACWRAIPPQGYRALGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 349 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDARSGKSKDYACWRAIPAQGYRALGDVMMLATSGYNPPNLPDYVCVHQSLCADVQTLQNRVYWDKGTGARKDVSLWQPGAAGAVASSCFAGVPNYNNPPNSGDIERLRGSIACVKTSAIASMQEMKSMLSQHQGMEAMMSKL

SEQ ID NO: 350 - protein, 537 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYRMVGQFAQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMKSKTV

SEQ ID NO: 351 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQVVSKEIEEYREKMSQHVGVSGRYKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 352 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 353 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSRDYACWRAVPAQGYRALGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 354 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYLSLPGAATLRSMLRRDFRDDINNPNMPAMEVFKRYGPYYLSEAAVGGRLDFSAASKTLKMDSSQSLSTTAEMSYKALVGEIKIEHGSEMEKQVNSFRSNSTIRLTATGGKPGMTDRIMHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 355 - protein, 536 aa, Artificial Sequence
  PHI-4 polypeptide variant
MRSVANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPPQGYRSMGDVMMLASSGYNPPNLPDYVCLHQSLCADVQTLQNRVWWDKGSGARKDVSLWQPGAVGAVASSCFAGVPNYNNPPNSGDIERLRGSIACVKTSAIASMQEMKSMLSQHQGMEAMMSKL

SEQ ID NO: 356 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADDHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 357 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQALSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 358 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 359 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGSGARKDVSLWQQGAAGAVASSCFAGVPNYNNPPNSGDIERLRGSIACVKTSAIASMQEMKSMLSQHQGMEAMMSKL

SEQ ID NO: 360 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRGMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 361 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRAWWDKGTGARKDVSLWQPGAAGAVASSCFAGVPNYNNPPNSGDIERLRGSIACVKTSAIASMQEMKSMLSQHQGMEAMMSKL

SEQ ID NO: 362 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 363 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 364 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSIFNASTSNGYKMIGQFGQRNHASVADGHAPIFKDLFDLGVLKAPVGWQRVWDDAGSGKSKDYACWRAVPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 365 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRIWDDAGSGKSKDYACWRAVPPQGYRAMGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 366 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMVGQFAQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 367 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPPQGYRALGDVMMLASSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 368 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMIGQFAQRNHASVADGHAPIFKDLFDLGVLKAPVGWQRVWDDAGSGKSKDYACWRAIAPQGYRAMGDVMMLASSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 369 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYIGLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 370 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRNNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCLHQSLCADVQTLQNRVWWDKGTGARKDVSLWQPGAAGAVASSCFAGVPNYNNPPNSGDIERLRGSIACAKTSAIASMQEMKSMLSQHQGMEAMMSKL

SEQ ID NO: 371 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREEMSQHVGVSGRFKLFSASLSVDFTTTDQQLTEITYSSTREAHVLWYISLPGAATLRSMLRRDFRDDIDNPNMPAMELFKRYGPYYLSEAAVGGRLDYSAASKTLKMDSSQSLSTTAEMSYKALVGEIKIEHGSEMEKQVDSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 372 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAIEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSVPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYACVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 373 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 374 - protein, 536 aa, Artificial Sequence
  PHI-4 polypeptide variant
MRSAANAGQLGNLPGVTGMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 375 - protein, 536 aa, Artificial Sequence
  PHI-4 polypeptide variant
MRSAANAGQLGNLPGVTSMGMGYNVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYLSLPGAATLRSMLRRDFRDDLNSPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 376 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFGQRNHASVADGHAPIFKDLFDLGVLKAPVGWQRVWDDAGSGKSKDYACWRAVAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 377 - protein, 536 aa, Artificial Sequence
  PHI-4 polypeptide variant
MRSAANAGQLGNLPGVTSMGMGYDVNGLYASPEALLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 378 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYLSLPGAATLRSMLRRDFRDDINNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 379 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWRDKGTGARKDVSLWQPGAAGAVASSCFAGVPNYNNPPNSGDIERLRGSIACVKTSAIASMQEMKSMLSQHQGMEAMMSKL

SEQ ID NO: 380 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYISEAAVGGRLDYSAASKTLKMESSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 381 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWVESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 382 - protein, 536 aa, Artificial Sequence
  PHI-4 polypeptide variant
MRSAANAGQLGNLPGVTSMGMGYDVNGLYASPEALLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYLSLPGAATLRSMLRRDFRDDINNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPISGDIERLRGSIACVKTSAIASMQEMKSMLSQHQGMEAMMSKL

SEQ ID NO: 383 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWCISLPGAATLRSMLRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 384 - protein, 536 aa, Artificial Sequence
  PHI-4 polypeptide variant
MRSAANAGQLGNLPGVTSMGMGYDVNGLYASPESLLDQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLSGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRAMGDVMMLASSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 385 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFGQRNHASVADGHAPIFKDLFDLGVLKAPVGWQRIWDNAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 386 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAFPPQGYRAMGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 387 - protein, 536 aa, Artificial Sequence
  PHI-4 polypeptide variant
MRSAANAGQLGILPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSRWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 388 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRIWDNAGSGKSKDYACWRAIAPQGYRAMGDVMMLATSGYNPPNLPDYVCVHQSLCADVQTLQNRVYWDKGTGARKDVSLWQPGAAGAVASSCFAGVPNYNNPPNSGDIERLRGSIACVKTSAIASMQEMKSMLSQHQGMEAMMSKL

SEQ ID NO: 389 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 390 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 391 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAVPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 392 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 393 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 394 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 395 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 396 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 397 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 398 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 399 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 400 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 401 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVSWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 402 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 403 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 404 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 405 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 406 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 407 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 408 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 409 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 410 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 411 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 412 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 413 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 414 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAVPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 415 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 416 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 417 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 418 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 419 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 420 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 421 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 422 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 423 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAVPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 424 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 425 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 426 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 427 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 428 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 429 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 430 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 431 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 432 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 433 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 434 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 435 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 436 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 437 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 438 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 439 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 440 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 441 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRDHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 442 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 443 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 444 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPAQGYRSMGDLMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 445 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 446 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 447 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 448 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPAQGYRSMGDLMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 449 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 450 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 451 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 452 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 453 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 454 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 455 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 456 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 457 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPAQGYRSMGDLMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 458 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 459 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 460 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPAQGYRSMGDLMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 461 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNDYKMIGQFGQRNHASVADGHAPIFKDLFDLGVLKAPVGWQRVWDDAGSGKSKDYACWRAIPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 462 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAVPPQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 463 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 464 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRSMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 465 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 466 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGWQRVWDDAGSGKSKDYACWRAIPAQGYRSMGDLMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 467 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 468 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRGMLRRDFRDDLNNPNMPAMELFKRYGPYYLSEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 469 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 470 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIKEYRGKMSQHVGVSGRFKLFSASLSVDFTTTDQQLTEITYSSTREAHVLWYLSLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAIPPQGYRAMGDVMMLATSGYNPPNLPDYVCLHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 471 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIAPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 472 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDIDNPNMPAMELFKRYGPYYLSEAAVGGRLDYSAASKTLKMESSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 473 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 474 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 475 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 476 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 477 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 478 - protein, 536 aa, Artificial Sequence
  PHI-4 polypeptide variant
MRSAANAGQLGNLPGVTGMGMGYNVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 479 - protein, 536 aa, Artificial Sequence
  PHI-4 polypeptide variant
MRSAANAGQLRYLPGVQSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITFSSTREAHVLWYISLPGAATLRSMVRRDFRDDINNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 480 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 481 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 482 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 483 - protein, 536 aa, Artificial Sequence
  PHI-4 polypeptide variant
MRSAANAGQLGNLPGVTSMGMGYDVNGLYASPEALLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDINNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 484 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 485 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 486 - protein, 536 aa, Artificial Sequence
  PHI-4 polypeptide variant
MRSAANAGQLGNLPGVTSMGMGYNVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 487 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDIDNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 488 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSDSGASEDLAIFNASTSNGYKMVGQFAQRNHASVADGHAPIFKDLFDLGVLKAPVGWQRIWDNAGSGKSKDYACWRAVPPQGYRSMGDVMMLASSGYNPPNLPDYVCLHQSLCADVQTLQNRVYWDKGSGARKDVSLWQPGAAGAVASSCFAGVPNYNNPPNSGDIERLRGSIACVKTSAIASMQEMKSMLSQHQGMEAMMSKL

SEQ ID NO: 489 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDINNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGGVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 490 - protein, 536 aa, Artificial Sequence
  PHI-4 polypeptide variant
MRSAANAGQLGNLPGVTSMGMGYNVNGLYASPESLLGQPIFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLDNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 491 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 492 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYLSLPGAATLRGMLRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 493 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRIWDNAGSGKSKDYACWRAVAPQGYRALGDLMMLASSGYNPPNLPDYVCLHQSLCADVQTLQNRVYWDKGTGARKDVSLWQPGAAGAVASSCFAGVPNYNNPPNSGDIERLRGSIACVKTSAIASMQEMKSMLSQHQGMEAMMSKL

SEQ ID NO: 494 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAYPEFMKQSQQSIPKVDKVLLMDARPPMVKAGEDSGSGASEDLAVFNPSTSNGYKMVGQFGQRNHASVADGRAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 495 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLDNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 496 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 497 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGAPNYNNPPNSGDIERLRGSIACVKTSAIASMQEMKSMLSQHQGMEAMMSKL

SEQ ID NO: 498 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 499 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSVACVKTSAIASMQEMKSMLSQHQGMEAMMSKL

SEQ ID NO: 500 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 501 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 502 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGDDSDSGASEDLSVFNPSTSNGYKMIGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVYWDKGTGARKDVSLWQPGAAGAVASSCFAGVPNYNNPPNSGDIERLRGSIACVKTSAIASMQEMKSMLSQHQGMEAMMSKL

SEQ ID NO: 503 - protein, 536 aa, Artificial Sequence
  PHI-4 polypeptide variant
MRSAANAGQLGNLPGVTSMGMGYNVNGLYASPESLLGQPIFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLDNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 504 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLRQHQGMEAMMSKL

SEQ ID NO: 505 - protein, 536 aa, Artificial Sequence
  PHI-4 polypeptide variant
MRSAANAGQLGNLPGVTSMGMGYNVNGLYASPESLLGQPIFNFGGELDSIEVEGRSYTFPRSMHVHTYFHSDFKQDVSKEIEEYREKMSQHVGVSGRFKLFSASLSVDFTTTDQQLTEITFSSTREAHVLWYISLPGAATLRSMLRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 506 - protein, 536 aa, Artificial Sequence
  PHI-4 polypeptide variant
MRSAANAGQLGNLPGVTSMGMGYDVNGLYASPEALLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 507 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 508 - protein, 536 aa, Artificial Sequence
  PHI-4 polypeptide variant
MRSAANAGQLGNLPGVTSMGMGYDVNGLYASPEALLGQPIFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLDNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 509 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTVEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 510 - protein, 536 aa, Artificial Sequence
  PHI-4 polypeptide variant
MRFAGNAGQLGNLPGVTSMGMGYDVNGLYASPESLLGQPLFDFGGELDSIEIEGRSYTFPRSMHVHTYFHSDFKQDVGKEIEEYREKMSQHVGVSGRYKLFSASLSVDFTTTDQQLTEITYSSTREAHVLWYISLPGAATLRSMLRRDFRDDLNNPNMPAMEVFKRYGPYYLSEAAVGGRLDYSAASKTLKMDSSQSLSTTAEMSYKALVGEIKIKHGSEMEKQVNSFRTNSTIRRTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 511 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYLSLPGAATLRSMLRRDFRDDLNNPNMPAMELFKRYGPYYLSEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 512 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGTTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 513 - protein, 536 aa, Artificial Sequence
  PHI-4 polypeptide variant
MRSAANAGQLGNLPGVTSMGMGYDVNGLYASPESLLGQPIFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARRDVSLWQPGAAGAVASSCFAGVPNYNNPPNSGDIERLRGSIACVKTSAIASMQEMKSMLSQHQGMEAMMSKL

SEQ ID NO: 514 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFAQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAICSMQEMKSMLSQHQGMEAMMSKL

SEQ ID NO: 515 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTSTDQQLTEITYSSTREAHVLWYISLPGAATLRSMLRRDFRDDINNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 516 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDINNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 517 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 518 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 519 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITFSSTREAHVLWYISLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 520 - protein, 536 aa, Artificial Sequence
  PHI-4 polypeptide variant
MRSAANAGQLGNLPGVTSMGMGYDVNGLYASPEALLGQPIFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 521 - protein, 536 aa, Artificial Sequence
  PHI-4 polypeptide variant
MRSAANAGQLGNLPGVTSMGMGYNVNGLYASPESLLGQPIFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDIDNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 522 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQTFSQWAESLLDYATLMDFSTESLQPIWALADKPERRVEIEDAYPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 523 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMVGQFGQRNHASVADGHAPIFKDLFDLGVLKAPVGWQRVWDDAGSGKSKDYACWRAIAPQGYRAMGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMASQHQGMEAMMSKL

SEQ ID NO: 524 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 525 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITFSSTREAHVLWYLSLPGAATLRSMLRRDFRDDINNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFQDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 526 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMVGQFGQRNHASVADGHAPIFKDLFDLGVLKAPVGWQRVWDDAGSGKSKDYACWRAVPPQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMASQHQGMEAMMSKL

SEQ ID NO: 527 - protein, 536 aa, Artificial Sequence
  PHI-4 polypeptide variant
MRSAANAGQLGNLPGVTSMGMGYNVNGLYASPESLLGQPIFNFGGELDSIEVEGRSYTFPRSMHVHTYFHSDFKQDVGKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGAREDVSLWQPGAAGAVASSCFAGVPNYNNPPNSGDIERLRGSIACVKTSAIASMQEMKSMLSQHQGMEAMMSKL

SEQ ID NO: 528 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 529 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVGKEIEEYREKMSQHVGVSGRYKLFSASLSVDFTTTDQQLTEITFSSTREAHVLWYISLPGAATLRSMLRRDFRDDLDNPNMPAMELFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 530 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDINNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKRSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 531 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 532 - protein, 536 aa, Artificial Sequence
  PHI-4 polypeptide variant
MRSAANAGQLGNLPGVTSMGMGYDVNGLYASPESLLGQPLFGFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRALGDVMMLASSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMASQHQGMEAMMSKL

SEQ ID NO: 533 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDGQQAFSQWAESLLDYATLMDFSTESLQPIWALADKPERRVELEDAFPEFMKQSQQSIPKVDKVLLMDARPPMVKAGEDSGSGASEDLAIFNASTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 534 - protein, 536 aa, Artificial Sequence
  PHI-4 polypeptide variant
MRSAANAGQLGNLPGVTSMGMGYNVNGLYASPESLLGQPLFDFGGELDSIEVEGRSYTFPRSMHVHTYFHSDFKQDVSKEIEEYREKMSQHVGVSGRYKLFSASLSVDFTTTDQQLTEITYSSTREAHVLWYLSLPGAATLRSMVRRDFRDDLNNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 535 - protein, 536 aa, Artificial Sequence
  PHI-4 polypeptide variant
MRSAANAGQLGNLPGVTSMGMGYDVNGLYASPESLLGQPLFDFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAYPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 536 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMIGQFAQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 537 - protein, 536 aa, Artificial Sequence
  PHI-4 polypeptide variant
MRSAANAGQLGNLPGVTSMGMGYDVNGLYASPESLLGQPIFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDIDNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 538 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPVWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 539 - protein, 536 aa, Artificial Sequence
  PHI-4 polypeptide variant
MRSAANAGQLGNLPGVTSMDMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSRDYACWRAVPAQGYRSLGDVMMLATSGYNPPNLPDYVCVHQSLCADVQTLQNRVYWDKGTGARKDVSLWQPGAAGAVASSCFAGVPNYNNPPNSGDIERLRGSIACVKTSAIASMQEMKSMASQHQGMEAMMSKL

SEQ ID NO: 540 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRYKLFSASLSVDFTTTDQQLTEITFSSTREAHVLWYLSLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 541 - protein, 536 aa, Artificial Sequence
  PHI-4 polypeptide variant
MRSAANAGQLGNLPGVTSMGMGYNVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMVRRDFRDDLNNPNMPAMEVFKRYGPYYLSEAAVGGRLDYSAASKALKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYSNPPNSGDIERLRGSIACVKTSAIASMQEMKSMLSQHQGMEAMMSKL

SEQ ID NO: 542 - protein, 536 aa, Artificial Sequence
  PHI-4 polypeptide variant
MRSAANAGQLGNLPGVTSMGMGYNVNGLYASPESLLGQPLFDFGGELDSIEVEGRSYTFPRSMHVHTYFHSDFKQDVGKEIEEYREKMSQHVGVSGRYKLFSASLSVDFTTTDQQLTEITYSSTREAHVLWYISLPGAATLRSMLRRDFRDDLDNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 543 - protein, 536 aa, Artificial Sequence
  PHI-4 polypeptide variant
MRSAANAGQLGNLPGVTSMGMGYDVNGLYASPESLLGQPIFNFGGELDSIEVEGRSYTFPRSMHVHTYFHSDFKQDVGKEIEEYREKMSQHVGVSGRYKLFSASLSVDFTTTDQQLTEITFSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 544 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNASTSNGYKMVGQFAQRNHASVADGHAPIFKDLFDLGVLKAPVGWQRIWDDAGSGKSKDYACWRAIPPQGYRSLGDVMMLASSGYNPPNLPDYVCVHQSLCADVQTLQNRVYWDKGTGARKDVSLWQPGAAGAVASSCFAGVPNYNNPPNSGDIERLRGSIACVKTSAIASMQEMKSMLSQHQGMEAMMSKL

SEQ ID NO: 545 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSVFNASTSNGYKMVGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMKSKL

SEQ ID NO: 546 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDLKQDVSKEIEEYREKMSQHVGVSGRYKLFSASLSVDFTTTDQQLTEITYSSTREAHVLWYLSLPGAATLRSMLRRDFRDDINNPNMPAMELFKRYGPYYISEAAVGGRLDYSAASKTLKMDSSQSLSTTVEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 547 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDFKQDVSKEIEEYREKMSQHVGVSGRYKLFSASLSVDFTTTDQQLTEITFSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 548 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDNAGSGKSKDYACWRAVAAQGYRSMGDLMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMASQHQGMEAMMSKL

SEQ ID NO: 549 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 550 - protein, 536 aa, Artificial Sequence
  PHI-4 polypeptide variant
MRSAANAGQLGNLPGVTSMGMGYNVNGLYASPESLLGQPIFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMVRRDFRDDINNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAYPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 551 - protein, 536 aa, Artificial Sequence
  PHI-4 polypeptide variant
MRSAANAGQLGNLPGVTSMGMGYDVNGLYASPEALLGQPLFNFGGELDSIEIEGRSYTFPRSMHVHTYFHSDFKQDVGKEIEEYREKMSQHVGVSGRYKLFSASLSVDFTTTDQQLTEITYSSTREAHVLWYISLPGAATLRSMLRRDFRDDIDNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 552 - protein, 536 aa, Artificial Sequence
  PHI-4 polypeptide variant
MRSAANAGQLGNLPDVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLSIFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 553 - protein, 536 aa, Artificial Sequence
  PHI-4 polypeptide variant
MRCAANAGQLGNLPGVTSMGMGYDVNGLYASPEALLGQPIFNFGGELDSIEIEGRSYTFPRSMHVHTYFHSDFKQDVGKEIEEYREKMSQHVGVSGRYKLFSASLSVDFTTTDQQLTEITYSSTREAHVLWYISLPGAATLRSMLRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 554 - protein, 536 aa, Artificial Sequence
  PHI-4 polypeptide variant
MRSAANAGQLGNLPGVTSMGMGYDVNGLYASPEALLGQPLFDFGGELDSIEIEGRSYTFPRSMHVHTYFHSDFKQDVGKEIEEYREKMSQHVGVSGRYKLFSASLSVDFTTTDQQLTEITYSSTREAHVLWYLSLPGAATLRSMLRRDFRDDLNNPNMPAMEVFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVEIEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 555 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAVSLLDYATLMDFSTESLQPIWALADKPERRVELEDAFPEFMKQSQQSIPKVDKVLLMDARPPMVKAGDDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCLHQSLCADVQTLQNRVYWDKGSGARKDVSLWQPGAAGAVASSCFAGVPNYNNPPNSGDIERLRGSIAGVKTSAIASMQEMKSMASQHQGMEAMMSKL

SEQ ID NO: 556 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVGKEIEEYREKMSQHVGVSGRYKLFSASLSVDFTTTDQQLTEITYSSTREAHVLWYLSLPGAATLRSMLRRDFRDDINNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 557 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYAALMDFSTESLQPIWALADKPERRVELEDAFPEFMKQSQQSIPKVDKVLLMDARPPMVKAGEDSGSGASEDLAIFNPSTSNGYKMVGQFAQRNHASVADGHAPIFKDLFDLGVLKAPVGWQRIWDNAGSGKSKDYACWRAIAPQGYRSMGDVMMLASSGYNPPNLPDYVCVHQSLCADVQTLQNRVYWDKGSGARKDVSLWQPGAAGAVASSCFAGVPNYNNPPNSGDIERLRGSIACVKTSAIASMQEMKSMASQHQGMEAMMSKL

SEQ ID NO: 558 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGDDSDSGASEDLAVFNPSTSNGYKMIGQFGQRNHASVADGHAPIFKDLFDLGVLKAPVGWQRVWDNAGSGKSKDYACWRAIPPQGYRAMGDVMMLASSGYNPPNLPDYVCVHQSLCADVQTLQNRVYWDKGTGARKDVSLWQPGAAGAVASSCFAGVPNYNNPPNSGDIERLRGSIACVKTSAIASMQEMKSMASQHQGMEAMMSKL

SEQ ID NO: 559 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 560 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 561 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 562 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 563 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 564 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 565 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 566 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 567 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 568 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 569 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 570 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 571 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 572 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 573 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 574 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 575 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 576 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 577 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 578 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 579 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 580 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 581 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 582 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 583 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 584 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 585 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 586 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAVPAQGYRSLGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 587 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 588 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 589 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 590 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 591 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 592 - protein, 536 aa, Artificial Sequence
  PHI-4 polypeptide variant
MRSAANAGQLGNLPGVTSMGMGYDVNGLYASPESLLGQPIFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 593 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 594 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 595 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 596 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 597 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 598 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 599 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 600 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 601 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 602 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKLVGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 603 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 604 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMEVFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 605 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 606 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 607 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 608 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 609 - protein, 536 aa, Artificial Sequence
  PHI-4 polypeptide variant
MRSAANAGQLGNLPGVTSMGMGYDVNGLYASPESLLGQPIFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLQYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 610 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 611 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 612 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 613 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 614 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 615 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKLVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWNDKGTGARKDVSLWQPGAAGAVASSCFAGVPNYNNPPNSGDIERLRGSIACVKTSAIASMQEMKSMLSQHQGMEAMMSKL

SEQ ID NO: 616 - protein, 536 aa, Artificial Sequence
  PHI-4 polypeptide variant
MRSAANAGQLGNLPGVTSMGMGYDVNGLYASPESLLGQPIFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 617 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 618 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 619 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 620 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNQIWWDKGTGARKDVSLWQPGAAGAVASSCFAGVPNYNNPPNSGDIERLRGSIACVKTSAIASMQEMKSMLSQHQGMEAMMSKL

SEQ ID NO: 621 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 622 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 623 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 624 - protein, 536 aa, Artificial Sequence
  PHI-4 polypeptide variant
MRSAANAGQLGNLPGVTSMGMGYDVNGLYASPESLLGQPLFDEGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 625 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 626 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNASTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 627 - protein, 536 aa, Artificial Sequence
  PHI-4 polypeptide variant
MRSAANAGQLGNLPGVTSMGMGYDVNGLYASPESLLGQPIFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 628 - protein, 536 aa, Artificial Sequence
  PHI-4 polypeptide variant
MRSAANAGQLGNLPGVTSMGMGYDVNGLYASPESLLGQPIFDEGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 629 - protein, 536 aa, Artificial Sequence
  PHI-4 polypeptide variant
MRSAANAGQLGNLPGVTSMGMGYDVNGLYASPESLLGQPIFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 630 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGLQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 631 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 632 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 633 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 634 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNQVWWDKGTGARKDVSLWQPGAAGAVASSCFAGVPNYNNPPNSGDIERLRGSIACVKTSAIASMQEMKSMLSQHQGMEAMMSKL

SEQ ID NO: 635 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 636 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 637 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 638 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRVWNDKGTGARKDVSLWQPGAAGAVASSCFAGVPNYNNPPNSGDIERLRGSIACVKTSAIASMQEMKSMLSQHQGMEAMMSKL

SEQ ID NO: 639 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 640 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKLIGQFGQRNHASVADGRAPIFKDLFDLGVLKAPVGWQRVWDDAGSGKSKDYACWRAVPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 641 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 642 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 643 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 644 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 645 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 646 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 647 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 648 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 649 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 650 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 651 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 652 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWNDKGTGARKDVSLWQPGAAGAVASSCFAGVPNYNNPPNSGDIERLRGSIACVKTSAIASMQEMKSMLSQHQGMEAMMSKL

SEQ ID NO: 653 - protein, 536 aa, Artificial Sequence
  PHI-4 polypeptide variant
MRSAANAGQLGNLPGVTSMGMGYDVNGLYASPESLLGQPIFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 654 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 655 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLSVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 656 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNQIWNDKGTGARKDVSLWQPGAAGAVASSCFAGVPNYNNPPNSGDIERLRGSIACVKTSAIASMQEMKSMLSQHQGMEAMMSKL

SEQ ID NO: 657 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 658 - protein, 536 aa, Artificial Sequence
  PHI-4 polypeptide variant
MRSAANAGQLGNLPGVTSMGMGYDVNGLYASPESLLGQPIFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 659 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 660 - protein, 536 aa, Artificial Sequence
  PHI-4 polypeptide variant
MRSAANAGQLGNLPGVTSMGMGYDVNGLYASPESLLGQPIFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 661 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 662 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 663 - protein, 536 aa, Artificial Sequence
  PHI-4 polypeptide variant
MRSAANAGQLGNLPGVTSMGMGYDVNGLYASPESLLGQPIFDFGGELDSIEVEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDINNPNMPAMEVFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADNPERRVELEDAFPEFMKQSQQSIPKVDKVLLMDARPPMVKAGEDSGSGASEDLSVFNASTSNGYKMVGQFAQRNHASVADGHAPIFKDLFDLGVLKAPVGLQRVWDDAGSGKSKDYACWRAIPAQGYRALGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 664 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 665 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 666 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 667 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 668 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 669 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 670 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRVWNDKGTGARKDVSLWQPGAAGAVASSCFAGVPNYNNPPNSGDIERLRGSIACVKTSAIASMQEMKSMLSQHQGMEAMMSKL

SEQ ID NO: 671 - protein, 536 aa, Artificial Sequence
  PHI-4 polypeptide variant
MRSAANAGQLGNLPGVTSMGMGYDVNGLYASPESLLGQPIFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 672 - protein, 536 aa, Artificial Sequence
  PHI-4 polypeptide variant
MRSAANAGQLGNLPGVTSMGMGYDVNGLYASPESLLGQPIFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 673 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 674 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRSLGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 675 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 676 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 677 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 678 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 679 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 680 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 681 - protein, 536 aa, Artificial Sequence
  PHI-4 polypeptide variant
MRSAANAGQLGNLPGVTSMGMGYDVNGLYASPESLLGQPIFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 682 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWNDKGTGARKDVSLWQPGAAGAVASSCFAGVPNYNNPPNSGDIERLRGSIACVKTSAIASMQEMKSMLSQHQGMEAMMSKL

SEQ ID NO: 683 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 684 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 685 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 686 - protein, 536 aa, Artificial Sequence
  PHI-4 polypeptide variant
MRSAANAGQLGNLPGVTSMGMGYDVNGLYASPESLLGQPIFNFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDINNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPAQGYRSLGDVMMLASSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 687 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 688 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 689 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 690 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKLIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 691 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 692 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 693 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 694 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 695 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFAQRNHASVADGHAPIFKDLFDLGVLKAPVGWQRVWDDAGSGKSKDYACWRAVPPQGYRSLGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 696 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 697 - protein, 536 aa, Artificial Sequence
  PHI-4 polypeptide variant
MRSAANAGQLGNLPGVTSMGMGYDVNGLYASPESLLGQPIFDFGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRIWNDQGTGARKDVSLWQPGAAGAVASSCFAGVPNYNNPPNSGDIERLRGSIACVKTSAIASMQEMKSMLSQHQGMEAMMSKL

SEQ ID NO: 698 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRSLGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 699 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 700 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 701 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMEVFKRYGPYYLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 702 - protein, 536 aa, Artificial Sequence
  PHI-4 polypeptide variant
MRSAANAGQLGNLPGVTSMGMGYDVNGLYASPESLLGQPLFNFGGELDSIEVEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAVPAQGYRSLGDVMMLATSGYNPPNLPDYVCVHQSLCADVQTLQNRVWWDKGSGARKDVSLWQPGAAGAVASSCFAGVPNYNNPPNSGDIERLRGSIACVKTSAIASMQEMKSMLSQHQGMEAMMSKL

SEQ ID NO: 703 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 704 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 705 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 706 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 707 - protein, 536 aa, Artificial Sequence
  PHI-4 polypeptide variant
MRSAANAGQLGNLPGVTSMGMGYDVNGLYASPESLLGQPIFNFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYYLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 708 - protein, 536 aa, Artificial Sequence
  PHI-4 polypeptide variant
MRSAANAGQLGNLPGVTSMGMGYDVNGLYASPESLLGQPLFNEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALIGEIKIEHGSEMEKQVNSFRSNSTIRLTATGGKPGMTDRILHGPDSQQAFSQWAESLLDYATLMDFSTESLQPVWALADKPERRVELEDAFPEFMKQSQQSIPKVDKVLLMDARPPMVKAGEDSGSGASEDLAVFNPSTSNGYKMIGQFGQRNHASVADGRAPIFKDLFDLGVLKAPVGWQRVWDDAGSGKSKDYACWRAIPPQGYRALGDVMMLATSGYNPPNLPDYVCVHESLCADVQTLQNRIWWDKGTGARKDVSLWQPGAAGAVASSCFAGVPNYNNPPNSGDIERLRGSIACVKTSAIASMQEMKSMLSQHQGMEAMMSKL

SEQ ID NO: 709 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLQYSAASKTLKMDSSQSLSTTAEMSYKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 710 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRIWDNAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 711 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDNAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 712 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 713 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYISEAAVGGRLDYSAASKTLKMDSSQSLSTTVEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFAQRNHASVADGHAPIFKDLFDLGVLKAPVGWQRIWDNAGSGKSKDYACWRAIPPQGYRALGDLMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 714 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDNAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 715 - protein, 536 aa, Artificial Sequence
  PHI-4 polypeptide variant
MRSAANAGQLGNLPGVTGMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYLSLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRIWDNAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 716 - protein, 536 aa, Artificial Sequence
  PHI-4 polypeptide variant
MRSAANAGQLGNLPGVTSMGMGYDVNGLYASPESLLGQPLFDEGGELDSIEIEGRSYTFPRSMHVHTYFHSDFKQDVSKEIEEYREKMSQHVGVSGRFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSFKALVGEIKIEHGSEMEKQVNSFRSNSTIRLTATGGKPGMTDRILHGPDSQQAFSQWAESLLDYATLMDFSTNSLQPIWALADKPERRVELEDAFPEFMKQSQQSIPKVDKVLLMDARPPMVKAGEDSGSGASQDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHESLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 717 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKKKYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 718 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHGDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 719 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHKYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 720 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKKKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 721 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKSKYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 722 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHWYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 723 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKSHDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 724 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKKGYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 725 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHWYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 726 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKKKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 727 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 728 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHHDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 729 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKGHDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 730 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHGYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 731 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKKWYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 732 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKGHYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 733 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKSGDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 734 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKSHDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 735 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKHWYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 736 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHWYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 737 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKSHDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 738 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKGGYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 739 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKPHYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 740 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 741 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKKKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 742 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHHYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 743 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 744 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKSGDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 745 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKHWDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 746 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKSGYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 747 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKGKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 748 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKPKYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 749 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKSGYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 750 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKGGDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 751 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKGKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 752 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHWDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 753 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHWDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 754 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKPGYYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 755 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKSGDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 756 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKGKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 757 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKPGDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 758 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 759 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 760 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 761 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 762 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 763 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 764 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 765 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 766 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 767 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 768 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 769 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 770 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSRSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 771 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 772 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 773 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKRSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 774 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 775 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 776 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 777 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSGASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 778 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 779 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSRSGASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 780 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSRSAASEDLAVFNPSTSNGYKMIGQFGQRNHASVADGHAPIFKDLFDLGVLKAPVGWQRVWDDAGSGKSKDYACWRAVPPQGYRALGDVMMLATSGYNPPNLPDYVCVHQSLCADVQTLQNRIWNDKGTGAAKDVSLWQPGAAGAVASSCFAGVPNYNNPPNSGDIERLRGSIACVKTSAIASMQEMKSMLSQHQGMEAMMSKL

SEQ ID NO: 781 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSRSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 782 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDVRSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGADKDVSLWQPGAAGAVASSCFAGVPNYNNPPNSGDIERLRGSIACVKTSAIASMQEMKSMLSQHQGMEAMMSKL

SEQ ID NO: 783 - protein, 536 aa, Artificial Sequence
  PHI-4 polypeptide variant
MRSAANAGQLGNLPGVTSMGMGYDVNGLYASPESLLGQPLFDFGGNLDSIEIEGRSYTFPRSMHVHTYFHSDFKQDVSKEIEEYREKMSQHVGVSGNFKLFSASLSVDFTTTDQQLTEITYSSTREAHVLWYISLPGAATLRSMVRRDFRDDLNNPNMPAMELFKRYGPYFLSEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKRSAASEDLAVFNPSTSNGYKMIGQFGQRNHASVADGHAPIFKDLFDLGVLKAPVGWQRVWDDAGSGKHKDYACWRAVPPQGYRALGDVMMLATSGYNPPNLPDYVCVHQSLCADVQTLQNRIWNDKGTGARKDVSLWQPGAAGAVASSCFAGVPNYNNPPNSGDIERLRGSIACVKTSAIASMQEMKSMLSQHQGMEAMMSKL

SEQ ID NO: 784 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 785 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 786 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 787 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 788 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 789 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 790 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 791 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 792 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 793 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 794 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 795 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 796 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 797 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 798 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 799 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 800 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 801 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 802 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 803 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 804 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 805 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 806 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 807 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 808 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 809 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 810 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 811 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 812 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 813 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 814 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 815 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 816 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKSKDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 817 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 818 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKSKDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 819 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 820 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 821 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISKAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 822 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISNAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 823 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 824 - protein, 536 aa, Artificial Sequence
  PHI-4 polypeptide variant
MRSAANAGQLGNLPGVTSMGMGYDVNGLYASPESLLGQPLFNFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 825 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 826 - protein, 536 aa, Artificial Sequence
  PHI-4 polypeptide variant
MRSAANAGQLGNLPGVTSMGMGYDVNGLYASPESLLGQPLFNFGGNLDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 827 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 828 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 829 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 830 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 831 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 832 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 833 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 834 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 835 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSLMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 836 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSVMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 837 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSRMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 838 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSYMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 839 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 840 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSFMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQSGAAGAVASSCFAGVPNYNNPPNSGDIERLRGSIACVKTSAIASMQEMKSMLSQHQGMEAMMSKL

SEQ ID NO: 841 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSCMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 842 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSAMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 843 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSSMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 844 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSIMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 845 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSTMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 846 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSWMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 847 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADYPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 848 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADSPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 849 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADRPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 850 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADGPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 851 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGIYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADWPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 852 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADFPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 853 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADVPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 854 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADPPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 855 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADNPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 856 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADQPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 857 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADTPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 858 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADAPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 859 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSHMEKQVNSFRSNSTIRLTATGGKPGMTDRILHGPDSQQAFSQWAESLLDYATLMDFSTESLQPIWALADFPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 860 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGFYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 861 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGHYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 862 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGKYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 863 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGTYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 864 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 865 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGWYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 866 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGIYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 867 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGVYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 868 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGQYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 869 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGTYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 870 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGCYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 871 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGGYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 872 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGSYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 873 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 874 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 875 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGPYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 876 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGKYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 877 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGAYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 878 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 879 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGMYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 880 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGHYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 881 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYWLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 882 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYILFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 883 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYMLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 884 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYFLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 885 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 886 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 887 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 888 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADMPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 889 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMAQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 890 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMIQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 891 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMMQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 892 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMNQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 893 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMTQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 894 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMVQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 895 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGAYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 896 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGCYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 897 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 898 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGFYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 899 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGGYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 900 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGKYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 901 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 902 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGSYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 903 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGTYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 904 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGVYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 905 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGYYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 906 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYFLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 907 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGRYILFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 908 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGAYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 909 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGCYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 910 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGHYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 911 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 912 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGFYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 913 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGGYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 914 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGLYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 915 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGQYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 916 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGSYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 917 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGTYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 918 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGVYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 919 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYILFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 920 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYMLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 921 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYYLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 922 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 923 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGYYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 924 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 925 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMNLFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 926 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIEKLRGSIACVKTSAIASMQEMKSMLSQHQGMEAMMSKL

SEQ ID NO: 927 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFNDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 928 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMLLFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 929 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSAWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 930 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISNAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 931 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWMPGAAGAVASSCFAGVPNYNNPPNSGDIERLRGSIACVKTSAIASMQEMKSMLSQHQGMEAMMSKL

SEQ ID NO: 932 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQHVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 933 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLANRVWWDKGTGARKDVSLWQPGAAGAVASSCFAGVPNYNNPPNSGDIERLRGSIACVKTSAIASMQEMKSMLSQHQGMEAMMSKL

SEQ ID NO: 934 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMHSMLSQHQGMEAMMSKL

SEQ ID NO: 935 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 936 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 937 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 938 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 939 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 940 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISSAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 941 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISSAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 942 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISSAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 943 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISNAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 944 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 945 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISSAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 946 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISSAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 947 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISSAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 948 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISNAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 949 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMKSMLSQHQGMEAMMSKL

SEQ ID NO: 950 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMASMLSQHQGMEAMMSKL

SEQ ID NO: 951 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMASMLSQHQGMEAMMSKL

SEQ ID NO: 952 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMASMLSQHQGMEAMMSKL

SEQ ID NO: 953 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMASMLSQHQGMEAMMSKL

SEQ ID NO: 954 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISVAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMASMLSQHQGMEAMMSKL

SEQ ID NO: 955 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGNYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVATSAIASMQEMASMLSQHQGMEAMMSKL

SEQ ID NO: 956 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 957 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 958 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 959 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDGGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 960 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 961 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 962 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 963 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 964 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKHKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 965 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 966 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 967 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 968 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKSKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 969 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 970 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 971 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 972 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKSKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 973 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 974 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 975 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 976 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 977 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 978 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 979 - protein, 536 aa, Artificial Sequence; identical to SEQ ID NO: 814
  PHI-4 polypeptide variant

SEQ ID NO: 980 - protein, 536 aa, Artificial Sequence; identical to SEQ ID NO: 804
  PHI-4 polypeptide variant

SEQ ID NO: 981 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKKWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 982 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 983 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 984 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 985 - protein, 536 aa, Artificial Sequence; identical to SEQ ID NO: 229
  PHI-4 polypeptide variant

SEQ ID NO: 986 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 987 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 988 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 989 - protein, 536 aa, Artificial Sequence; identical to SEQ ID NO: 242
  PHI-4 polypeptide variant

SEQ ID NO: 990 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 991 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 992 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 993 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKHKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 994 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKKWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 995 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDLGSGKHKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 996 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 997 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 998 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDGGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 999 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1000 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDGGSGKKKDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1001 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1002 - protein, 536 aa, Artificial Sequence; identical to SEQ ID NO: 239
  PHI-4 polypeptide variant

SEQ ID NO: 1003 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1004 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1005 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1006 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1007 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKHWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1008 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1009 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1010 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1011 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKKWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1012 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1013 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1014 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1015 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1016 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1017 - protein, 536 aa, Artificial Sequence; identical to SEQ ID NO: 812
  PHI-4 polypeptide variant

SEQ ID NO: 1018 - protein, 536 aa, Artificial Sequence; identical to SEQ ID NO: 786
  PHI-4 polypeptide variant

SEQ ID NO: 1019 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1020 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1021 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1022 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1023 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1024 - protein, 536 aa, Artificial Sequence; identical to SEQ ID NO: 234
  PHI-4 polypeptide variant

SEQ ID NO: 1025 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKSKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1026 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1027 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1028 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1029 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1030 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1031 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1032 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1033 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1034 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1035 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKKWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1036 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1037 - protein, 536 aa, Artificial Sequence; identical to SEQ ID NO: 240
  PHI-4 polypeptide variant

SEQ ID NO: 1038 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1039 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1040 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1041 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDGGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1042 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKHGDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1043 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1044 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1045 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1046 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1047 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHKDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1048 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1049 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1050 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1051 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1052 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKSKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1053 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1054 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1055 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1056 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1057 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1058 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKSKYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1059 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1060 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1061 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1062 - protein, 536 aa, Artificial Sequence; identical to SEQ ID NO: 808
  PHI-4 polypeptide variant

SEQ ID NO: 1063 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1064 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1065 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDLGSGKHKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1066 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1067 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1068 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1069 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1070 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDGGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1071 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1072 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1073 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1074 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1075 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKGHYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1076 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1077 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHKYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1078 - protein, 536 aa, Artificial Sequence; identical to SEQ ID NO: 819
  PHI-4 polypeptide variant

SEQ ID NO: 1079 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1080 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1081 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1082 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKHWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1083 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1084 - protein, 536 aa, Artificial Sequence; identical to SEQ ID NO: 811
  PHI-4 polypeptide variant

SEQ ID NO: 1085 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDAGSGKKWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1086 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1087 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1088 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1089 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDLGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1090 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1091 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1092 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKHHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1093 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDGGSGKKGYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1094 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDGGSGKKKDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1095 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDAGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1096 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1097 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1098 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKHHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1099 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKKKDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1100 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDKGSGKKKDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1101 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDGGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1102 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1103 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1104 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1105 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1106 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDGGSGKSHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1107 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1108 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1109 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKHHDYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1110 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1111 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1112 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1113 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDKGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1114 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1115 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKHHDYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1116 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDAGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1117 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1118 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKHWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1119 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1120 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1121 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1122 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDVGSAASEDLAVFNPSTSNGYKMIGQFGQRNHASVADGHAPIFKDLFDLGVLKAPVGWQRVWDDLGSGKHWYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1123 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKHGYYACWRAIPAQGYRALGDVMMLATSGYNPPNLPDYVCVHQSLCADVQTLQNRVWWDKGTGAAKDVSLWQPGAAGAVASSCFAGVPNYNNPPNSGDIERLRGSIACVKTSAIASMQEMKSMLSQHQGMEAMMSKL

SEQ ID NO: 1124 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKHHDYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1125 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMVGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1126 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMIGQFGQRNHASVADGHAPIFKDLFDLGVLKAPVGWQRVWDDAGSGKKWYYACWRAIPAQGYRALGDVMMLATSGYNPPNLPDYVCVHQSLCADVQTLQNRVWWDKGTGADKDVSLWQPGAAGAVASSCFAGVPNYNNPPNSGDIERLRGSIACVKTSAIASMQEMKSMLSQHQGMEAMMSKL

SEQ ID NO: 1127 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSGASEDLAVFNPSTSNGYKMIGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1128 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERQVELEDAFPEFMKQSQQSIPKVDKVLLMDARPPMVKAGEDSGSAASEDLAVFNPSTSNGYKMVGQFGQRNHASVADGHAPIFKDLFDLGVLKAPVGWQRVWDDTGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1129 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSAASEDLAVFNPSTSNGYKMIGQFGQRNHASVADGHAPIFKDLFDLGVLKAPVGWQRVWDDTGSGKHHYYACWRAIPAQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1130 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTAASKDVSLWQPGAAGAVASSCFAGVPNYNNPPNSGDIERLRGSIACVKTSAIASMQEMKSMLSQHQGMEAMMSKL

SEQ ID NO: 1131 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDVGTGSKNDVSLWQPGAAGAVASSCFAGVPNYNNPPNSGDIERLRGSIACVKTSAIASMQEMKSMLSQHQGMEAMMSKL

SEQ ID NO: 1132 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGSKVDVSLWQPGAAGAVASSCFAGVPNYNNPPNSGDIERLRGSIACVKTSAIASMQEMKSMLSQHQGMEAMMSKL

SEQ ID NO: 1133 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDVGTGASNDVSLWQPGAAGAVASSCFAGVPNYNNPPNSGDIERLRGSIACVKTSAIASMQEMKSMLSQHQGMEAMMSKL

SEQ ID NO: 1134 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGSSKDVSLWQPGAAGAVASSCFAGVPNYNNPPNSGDIERLRGSIACVKTSAIASMQEMKSMLSQHQGMEAMMSKL

SEQ ID NO: 1135 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDVGTAARKDVSLWQPGAAGAVASSCFAGVPNYNNPPNSGDIERLRGSIACVKTSAIASMQEMKSMLSQHQGMEAMMSKL

SEQ ID NO: 1136 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDIGTGSKMDVSLWQPGAAGAVASSCFAGVPNYNNPPNSGDIERLRGSIACVKTSAIASMQEMKSMLSQHQGMEAMMSKL

SEQ ID NO: 1137 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDVGTGSSNDVSLWQPGAAGAVASSCFAGVPNYNNPPNSGDIERLRGSIACVKTSAIASMQEMKSMLSQHQGMEAMMSKL

SEQ ID NO: 1138 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDIGTGSRKDVSLWQPGAAGAVASSCFAGVPNYNNPPNSGDIERLRGSIACVKTSAIASMQEMKSMLSQHQGMEAMMSKL

SEQ ID NO: 1139 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTAAKMDVSLWQPGAAGAVASSCFAGVPNYNNPPNSGDIERLRGSIACVKTSAIASMQEMKSMLSQHQGMEAMMSKL

SEQ ID NO: 1140 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGSKNDVSLWQPGAAGAVASSCFAGVPNYNNPPNSGDIERLRGSIACVKTSAIASMQEMKSMLSQHQGMEAMMSKL

SEQ ID NO: 1141 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGSSKDVSLWQPGAAGAVASSCFAGVPNYNNPPNSGDIERLRGSIACVKTSAIASMQEMKSMLSQHQGMEAMMSKL

SEQ ID NO: 1142 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTAASNDVSLWQPGAAGAVASSCFAGVPNYNNPPNSGDIERLRGSIACVKTSAIASMQEMKSMLSQHQGMEAMMSKL

SEQ ID NO: 1143 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDMGTGARNDVSLWQPGAAGAVASSCFAGVPNYNNPPNSGDIERLRGSIACVKTSAIASMQEMKSMLSQHQGMEAMMSKL

SEQ ID NO: 1144 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDIGTGSKKDVSLWQPGAAGAVASSCFAGVPNYNNPPNSGDIERLRGSIACVKTSAIASMQEMKSMLSQHQGMEAMMSKL

SEQ ID NO: 1145 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGAKMDVSLWQPGAAGAVASSCFAGVPNYNNPPNSGDIERLRGSIACVKTSAIASMQEMKSMLSQHQGMEAMMSKL

SEQ ID NO: 1146 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGASKDVSLWQPGAAGAVASSCFAGVPNYNNPPNSGDIERLRGSIACVKTSAIASMQEMKSMLSQHQGMEAMMSKL

SEQ ID NO: 1147 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGASMDVSLWQPGAAGAVASSCFAGVPNYNNPPNSGDIERLRGSIACVKTSAIASMQEMKSMLSQHQGMEAMMSKL

SEQ ID NO: 1148 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDIGTGAKNDVSLWQPGAAGAVASSCFAGVPNYNNPPNSGDIERLRGSIACVKTSAIASMQEMKSMLSQHQGMEAMMSKL

SEQ ID NO: 1149 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGSKKDVSLWQPGAAGAVASSCFAGVPNYNNPPNSGDIERLRGSIACVKTSAIASMQEMKSMLSQHQGMEAMMSKL

SEQ ID NO: 1150 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGAKNDVSLWQPGAAGAVASSCFAGVPNYNNPPNSGDIERLRGSIACVKTSAIASMQEMKSMLSQHQGMEAMMSKL

SEQ ID NO: 1151 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTAASMDVSLWQPGAAGAVASSCFAGVPNYNNPPNSGDIERLRGSIACVKTSAIASMQEMKSMLSQHQGMEAMMSKL

SEQ ID NO: 1152 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGSRVDVSLWQPGAAGAVASSCFAGVPNYNNPPNSGDIERLRGSIACVKTSAIASMQEMKSMLSQHQGMEAMMSKL

SEQ ID NO: 1153 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGARNDVSLWQPGAAGAVASSCFAGVPNYNNPPNSGDIERLRGSIACVKTSAIASMQEMKSMLSQHQGMEAMMSKL

SEQ ID NO: 1154 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTAAKMDVSLWQPGAAGAVASSCFAGVPNYNNPPNSGDIERLRGSIACVKTSAIASMQEMKSMLSQHQGMEAMMSKL

SEQ ID NO: 1155 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDIGTGAKMDVSLWQPGAAGAVASSCFAGVPNYNNPPNSGDIERLRGSIACVKTSAIASMQEMKSMLSQHQGMEAMMSKL

SEQ ID NO: 1156 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDKGTGASNDVSLWQPGAAGAVASSCFAGVPNYNNPPNSGDIERLRGSIACVKTSAIASMQEMKSMLSQHQGMEAMMSKL

SEQ ID NO: 1157 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDVGTGARKDVSLWQPGAAGAVASSCFAGVPNYNNPPNSGDIERLRGSIACVKTSAIASMQEMKSMLSQHQGMEAMMSKL

SEQ ID NO: 1158 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDKGTGAKKDVSLWQPGAAGAVASSCFAGVPNYNNPPNSGDIERLRGSIACVKTSAIASMQEMKSMLSQHQGMEAMMSKL

SEQ ID NO: 1159 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDIGTGARNDVSLWQPGAAGAVASSCFAGVPNYNNPPNSGDIERLRGSIACVKTSAIASMQEMKSMLSQHQGMEAMMSKL

SEQ ID NO: 1160 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDVGTGSRNDVSLWQPGAAGAVASSCFAGVPNYNNPPNSGDIERLRGSIACVKTSAIASMQEMKSMLSQHQGMEAMMSKL

SEQ ID NO: 1161 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDLGSGKSHDYACWRAIPAQGYRALGDVMMLATSGYNPPNLPDYVCVHQSLCADVQTLQNRVWWDMGTGAKNDVSLWQPGAAGAVASSCFAGVPNYNNPPNSGDIERLRGSIACVKTSAIASMQEMKSMLSQHQGMEAMMSKL

SEQ ID NO: 1162 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDKGSAASEDLAVFNPSTSNGYKMIGQFGQRNHASVADGHAPIFKDLFDLGVLKAPVGWQRVWDDKGSGKKKYYACWRAIPAQGYRALGDVMMLATSGYNPPNLPDYVCVHQSLCADVQTLQNRVWWDIGTAARNDVSLWQPGAAGAVASSCFAGVPNYNNPPNSGDIERLRGSIACVKTSAIASMQEMKSMLSQHQGMEAMMSKL

SEQ ID NO: 1163 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1164 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcaaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1165 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcaacgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1166 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1167 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttaacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataagggcagcgcggcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1168 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1169 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttaacttcggtggtaacctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1170 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1171 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataaactgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataagccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1172 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataaactgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataagccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1173 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1174 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1175 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1176 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1177 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataagccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1178 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccttatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1179 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgttatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1180 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcaggatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1181 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagctatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1182 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1183 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagctttatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaatcgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1184 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagctgtatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1185 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgctatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1186 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcagtatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1187 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcattatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1188 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcactatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1189 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagctggatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1190 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggattatccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1191 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatagtccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1192 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatcggccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1193 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatggtccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1194 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtatttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggattggccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1195 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggattttccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1196 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatgtgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1197 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatcctccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1198 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataatccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1199 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatcagccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1200 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatactccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1201 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatgcgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1202 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggattttccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1203 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtttttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1204 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1205 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaagtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1206 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtacgtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1207 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1208 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttggtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1209 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtatttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1210 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgtgtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1211 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcagtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1212 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtacgtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1213 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttgttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaaaacctccgcaattgcatccatgcaagaaatgaagagcatgttgagccagcaccagggtatggaagcgatgatgtctaaactgtaa

SEQ ID NO: 1214 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtggttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1215 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtagttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1216 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgagtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1217 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1218 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtccttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1219 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaagtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1220 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgcttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1221 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaggtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1222 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtatgtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1223 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1224 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattattggctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1225 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatattctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1226 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatatgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1227 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattattttctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1228 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1229 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1230 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataagccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1231 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatatgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1232 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatggctcagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1233 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgattcagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1234 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgatgcagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1235 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaatcagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1236 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgacgcagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1237 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatggttcagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1238 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgcttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1239 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttgttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1240 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgagtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1241 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtttttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1242 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtggttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1243 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaagtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1244 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1245 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttcgtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1246 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtacttataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1247 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgtgtataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1248 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1249 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctattttctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1250 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcgctatattctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1251 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgcttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1252 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttgttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1253 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1254 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgagtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1255 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtttttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1256 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgggtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1257 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtctgtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1258 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtcagtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1259 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtagttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1260 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtacgtatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1261 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgtttatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1262 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatattctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1263 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatatgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1264 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattattatctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1265 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1266 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggttattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1267 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1268 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatgaatctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1269 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagaagctgcgtggtagcattgcctgtgtcaagacctccgcaattgcatccatgcaagaaatgaagagcatgttgagccagcaccagggtatggaagcgatgatgtctaaactgtaa

SEQ ID NO: 1270 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttcaatgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1271 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatgcttctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1272 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagcgcttgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1273 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcaatgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1274 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggatgccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1275 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcatgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1276 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctggcgaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1277 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgcatagcatgttgagccagcaccagggtatggaagcgatgatgtctaaactgtaa

SEQ ID NO: 1278 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgctacctccgcaattgcatccatgcaagaaatgaagagcatgttgagccagcaccagggtatggaagcgatgatgtctaaactgtaa

SEQ ID NO: 1279 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1280 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1281 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1282 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1283 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcagcgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1284 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcagcgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1285 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcagcgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1286 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcaacgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1287 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1288 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcagcgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1289 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcagcgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1290 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcagcgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1291 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcaacgcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactgtaa

SEQ ID NO: 1292 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatgaagagcatgttgagccagcaccagggtatggaagcgatgatgtctaaactgtaa

SEQ ID NO: 1293 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatggcgagcatgttgagccagcaccagggtatggaagcgatgatgtctaaactgtaa

SEQ ID NO: 1294 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgctacctccgcaattgcatccatgcaagaaatggcgagcatgttgagccagcaccagggtatggaagcgatgatgtctaaactgtaa

SEQ ID NO: 1295 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatggcgagcatgttgagccagcaccagggtatggaagcgatgatgtctaaactgtaa

SEQ ID NO: 1296 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatggcgagcatgttgagccagcaccagggtatggaagcgatgatgtctaaactgtaa

SEQ ID NO: 1297 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgtggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatggcgagcatgttgagccagcaccagggtatggaagcgatgatgtctaaactgtaa

SEQ ID NO: 1298 - DNA, 1611 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtaactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtactacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcgcaacctccgcaattgcatccatgcaagaaatggcgagcatgttgagccagcaccagggtatggaagcgatgatgtctaaactgtaa

SEQ ID NO: 1299 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1300 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1301 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1302 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1303 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1304 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1305 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1306 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1307 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1308 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1309 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1310 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1311 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagcaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1312 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1313 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1314 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1315 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagcaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1316 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1317 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1318 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1319 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1320 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1321 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1322 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1323 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1324 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagaagtggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1325 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1326 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1327 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1328 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1329 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1330 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1331 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1332 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1333 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1334 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1335 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1336 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1337 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagaagtggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1338 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1339 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1340 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1341 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1342 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1343 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagaagaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1344 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1345 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1346 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1347 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1348 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1349 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1350 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1351 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1352 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1353 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1354 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagaagtggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1355 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1356 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1357 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1358 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1359 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcacaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1360 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1361 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1362 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1363 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1364 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1365 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1366 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1367 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1368 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagcaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1369 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1370 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1371 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcacaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1372 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1373 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1374 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1375 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1376 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1377 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1378 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagaagtggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1379 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1380 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1381 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1382 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1383 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1384 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1385 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacggggattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1386 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1387 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1388 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1389 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcacaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1390 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcacaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1391 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1392 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1393 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1394 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1395 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagcaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1396 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1397 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1398 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1399 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1400 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1401 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagagcaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1402 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1403 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1404 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1405 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1406 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1407 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1408 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1409 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1410 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1411 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1412 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1413 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1414 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1415 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1416 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1417 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1418 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagggccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1419 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1420 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcacaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1421 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1422 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1423 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1424 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1425 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1426 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1427 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1428 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagaagtggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1429 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1430 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1431 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1432 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1433 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1434 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1435 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1436 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagaaggggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1437 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagaagaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1438 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1439 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1440 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1441 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1442 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1443 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaagattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1444 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1445 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1446 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1447 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1448 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1449 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacggaggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1450 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1451 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1452 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1453 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1454 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1455 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1456 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1457 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1458 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1459 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1460 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1461 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1462 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1463 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1464 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1465 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatgtgggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagcactggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1466 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcacgggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggctaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1467 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagcaccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1468 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1469 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagaagtggtattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcggataaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1470 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcggcgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1471 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcaggtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatggttggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccacgattacgcatgttggcgtgccattccgccccaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1472 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcgccgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacacgggctccggtaagcaccactattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1473 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccgcagcgagtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1474 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatgttggtaccggttccaagaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1475 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggttccaaggtggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1476 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatgttggtaccggtgcgagtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1477 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggttccagtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1478 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatgttggtaccgcagcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1479 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccggttccaagatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1480 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatgttggtaccggttccagtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1481 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccggttcccgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1482 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccgcagcgaagatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1483 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggttccaagaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1484 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggttccagtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1485 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccgcagcgagtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1486 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatatgggtaccggtgcgcgtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1487 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccggttccaagaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1488 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgaagatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1489 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgagtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1490 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgagtatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1491 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccggtgcgaagaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1492 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggttccaagaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1493 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgaagaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1494 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccgcagcgagtatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1495 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggttcccgtgtggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1496 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1497 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccgcagcgaagatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1498 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccggtgcgaagatggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1499 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgagtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1500 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatgttggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1501 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgaagaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1502 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccggtgcgcgtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1503 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatgttggtaccggttcccgtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1504 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgaccttggctccggtaagagccacgattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatatgggtaccggtgcgaagaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1505 - DNA, 1608 bp, ARTIFICIAL SEQUENCE
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgattatctgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagataagggcagcgctgcaagcgaggacctggcggtgttcaatccgagcaccagcaacggctacaagatgatcggccagtttggccaacgcaaccatgctagcgtggcagacggccacgctccgatcttcaaggacctgttcgatctgggtgttttgaaagccccggtgggctggcagcgtgtgtgggacgacaaaggctccggtaagaagaaatattacgcatgttggcgtgccattccggcgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggatattggtaccgcagcgcgtaacgacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1506 - protein, 489 aa, Serratia proteamaculans
MKIESSKVEGLFSSSFTRVNAVPLPSDTLPGVGIIGCGYNPFLAYADASAVLHPILDWSKSQFNEITMNGQQYQLPDVLQAVWLSNQSYASVTGKSLQSYLTELANSIKVSGNYGFFSASATNEFSDSSLRKSENEFSRCQQSFDLWSISIPADIARLQNYVSDDFIKLINAINPESKDSIATVFNVYGSHVLMSGVMGGKAHVSASANKLTLTQKFEMSTIVQAKYEQLTSQLSVEDKLKYSEAFDSFSESGSYTYDILGGSPSLGALVFKNNSQGSSDDNLKNWIQSISSMPVLTKFIDQTSLMPVWLLCEDKTKADALKKYYDNTWSKSQMAVASLRANYIDELTFVLGDNSDIPAPVGYTKVPIDLNSDAGGKYVYLCYHEAQFTPVNGKQPIVDIQVLYGSQMPAPGYIKIDVDLNSGAGGEFVYLSYKKGEPTSSDVINKITAVYGKNEYVPTPYGYKQISGDLNAGAGGDFVYLCTYQGGTE

SEQ ID NO: 1507 - protein, 510 aa, Photorhabdus luminescens
MSNDKTGKSLEQENSERDVEIRDRNYFRKLSLFDDTVIAGAEMIGTSYDVFGKYCNVGSCMNSLFDERKINASEDNFKKVTILGKTLKVPYYIDCYSVGDLKYTNASGESIESYQSNISSKSRIKGNYLFFSASLKVDFDTDSLTDFENAFSRIQYTYDLYILKSSAEALKEFLKESVKTALDKADTEEDMNDLFNTWGSHFLSGVVMGGCAQYSSSTNKYTSNLTNSFDVVAAASFAGFIGLSARTGNSFMEDIKKFRSASNIKTHAIGGDLSRFDPFGGATSADQPSAEEIAAAKKAFEDWKASVPNAPELVNFADSNPLTGIWELCSDRTQKAKLKKHFETVWAPAESAKRRVHADYIDEIIIGINNTNTPPEGYIGLKSTKDENLNSKGNICLFMHKAKYDPNIDNKDCITELKFITVRDKSPEGDWVKIPQDIYISPNQYLYLCYLPAKYSAEKAIKDIQLLCSSCGSSMILPYGYNDVLDERGERANATEDDNVHYLIYSAGWK

SEQ ID NO: 1508 - protein, 511 aa, Photorhabdus sp.
SMSNDKTGKSLEQENSERDVEIRDRNYFRKLSLFDDTVIAGAEMIGTSYDVFGKYCNVGSCMNSLFDERKINASEDNFKKVTILGKTLKVPYYIDCYSVGDLKYTNASGESIESYQSNISSKSRIKGNYLFFSASLKVDFDTDSLTDFENAFSRIQYTYDLYILKSSAEALKEFLKESVKTALDKADTEEDMNDLFNTWGSHFLSGVVMGGCAQYSSSTNKYTSNLTNSFDVVAAASFAGFIGLSARTGNSFMEDIKKFRSASNIKTHAIGGDLSRFDPFGGATSADQPSAEEIAAAKKAFEDWKASVPNAPELVNFADSNPLTGIWELCSDRTQKAKLKKHFETVWAPAESAKRRVHADYIDEIIIGINNTNTPPEGYIGLKSTKDENLNSKGNICLFMHKAKYDPNIDNKDCITELKFITVRDKSPEGDWVKIPQDIYISPNQYLYLCYLPAKYSAEKAIKDIQLLCSSCGSSMILPYGYNDVLDERGERANATEDDNVHYLIYSAGWK

SEQ ID NO: 1509 - DNA, 1611 bp, Artificial Sequence
  codon optimized
atggcttcagcagcaaatgcaggtcagcttggcaacctccccggcgttacttcgatgggcatgggctatgacgtgaatggtttgtacgccagcccggaaagcctgcttggccaacccttgttcgatttcggcggcgagctggacagcatcgaaatcgagggccgcagctacacctttccccgcagcatgcatgtacacacctatttccattccgacttcaaacaggatgtcagcaaggaaatcgaagagtatcgggagaaaatgagccagcacgtgggcgtgtccggcgactacctgttgttcagcgcttcgctgagcgtggatttcaccaccacggaccagcaactgaccgagattacctacagctccacccgcgaagcccacgtgctgtggtacatcagcctgcctggcgcggccacgctgcgttcgatgctgcgccgcgatttccgcgacgacctgaacaaccccaatatgccggcgatggagctgttcaagcgctatggtccctactacatatcggaagcggcggtgggcggccggctggactacagcgcggccagcaagaccttgaagatggacagcagccagtcgctgtccaccaccgccgaaatgtcctacaaggcgctggtgggcgagatcaagatcgagcacggctcggacatggaaaagcaggtcaacagcttccgcagcaactccaccatccgtctcaccgccaccggcggcaagccgggcatgaccgatcgcatactgcacggtccggattcgcagcaggcgttctcgcaatgggcggaatcgctgctcgactatgcgacgctgatggacttttccaccgaaagcctgcaaccgatctgggcgctggccgacctgcccgagcgccgcgtcgagcttgaggacgccttccccgaattcatgaagcagtcgcagcagtccatccccaaggtggacaaggtgctgctgatggacgcgcgcccgcctatggtgaaggctggggaggatagcggctcaggcgcgtcggaggatctggctgtgttcaatcccagcacctccaatggctacaagatgatcggccagttcggtcagcgcaaccatgccagcgtggcggatggccatgcgccgattttcaaggatctgttcgatctgggcgtgctgaaggcgccggtgggttggcagcgggtgtgggacgacgccggctccggcaagcatcatgactacgcgtgctggcgcgcgattccggcgcagggctaccgcgcgctgggcgatgtgatgatgctggccaccagcggctataacccgccgaatctgccggactatgtttgcgtgcaccaaagcctgtgcgcggatgtgcagacgctgcaaaaccgggtgtggtgggacaagggcaccggcgcgcgcaaggatgtcagcctgtggcaaccgggcgcggccggcgcggtggcgtcctcttgcttcgccggcgtgcctaattacaacaacccgcccaattccggcgacatcgagcgcttgcgcggcagcatcgcttgcgtgaagaccagcgcgatcgcgtccatgcaggaaatgaagtccatgctcagccagcaccaaggcatggaagcgatgatgtccaagctgtga

SEQ ID NO: 1510 - DNA, 66 bp, Zea mays
cttgcagcagcagaagcagaagcagatggagcatctcaacaagcagttgcaacaccaagactgaat

SEQ ID NO: 1511 - protein, 22 aa, Zea mays
LAAAEAEADGASQQAVATPRLN

SEQ ID NO: 1512 - DNA, 72 bp, Hordeum vulgare
atggccaacaagcacctgtccctctccctcttcctcgtgctcctcggcctctccgcctccctcgcctccgga

SEQ ID NO: 1513 - protein, 24 aa, Hordeum vulgare
MANKHLSLSLFLVLLGLSASLASG

SEQ ID NO: 1514 - protein, 4 aa, Artificial Sequence
  ER transit peptide
KDEL

SEQ ID NO: 1515 - DNA, 1710 bp, Sorghum bicolor
ttttaagtatgaccaatttttaagtataaacccctcacgattggttatttttttaagtataaccaatttttaagtataaacccctcaccaatttttaagtataaacctagcgactaataaacacaacttcttgccaaagtgtgagcatcaccattggatctgcgcccctcacgaacagtcttcgccggggtaaaattctccaaattaaagtcatcttgatgtccttgatcacctgtccataaggcccaatcccagctccacgtatacttctgataagattgacatagtcacttgcatgccagtgtggaactctggatgcctaggtcagaggctagtgactggccttcccggcatgctagcatgtagcatgccaaggatctggctgctccaggtttgttatgcctgacatcaccatagggatgagagcaagtataataataggctgtaagctttaaatgctcaggtggagaaaaaaaggagaggagaggagagagaaaagtgggctataagcttatagctgtgttagacataagaatcagaaacttcgtatgagagacaggtgagctatatattaataacaaagagctaactattatatgagtgaaccgagagaaggctgtaaaaaaacttacacaatcaacgatcgacattattattaaccttgctctgtcttgcgagacctctttgacaaagctacatcaatgccggccaagtgccttgggatttgggaatggcttctttcctcccttcctcggttgtcccccaaggcctaggcttgccacgctgtattcagtcgcagccgcctttacttttgccctttgtggaagttttgtaataaatggtctgattctatcttcggatagatgaagccggatgtttcatccattatctaaaaaaaagttggttgctttgctgagctaagaaagtgtaatccagagtgctcgtaacgtattaatgtacataactattatctaatataaatcttcttttgtcgcaaaaaaaggtcggcccatcagaacaaatgatcaatgtaaggcccaaaatttgtgtctcaaatgtcatttacgtttccaagctaaacaaaaacacaggattcatataattttgctggtggcttaggcttcgtccaatagtgcttagtttaatttgtatatacctgcaccatggtattcgtctggccttggatcttgcgcatcaattgcctatggacgatgatcgcagccacgccacattcatttttaatcgccatttgcttgacacccaatgcctctgcaccacttgcgcacgctacgcaccgtctgatacgccaagatcccgagctaaaataacacccaatcatcagatgaaaacaagcgcgagtgcgagccagcccatggcagcgatcttggccatttgcggagccaactgaaagccgtgcacaaaatattcgacaccgtataagggaaaacactagttatacgaggtgggcaataatccagatctcggactcttcctaacccggttcacatgcatagcatatatgatggccggccggggttcacatgaacgccatcccgtgccctagtgcactgatttcttaatcccgggtctcaactataaatacccccttggtgacaccgcgatcaaagcatcgcaaacaagcctagctaagagctctctaactacattagatagagtgatctcgagaggtaactggcttgtgatcgagca

SEQ ID NO: 1516 - protein, 401 aa, Escherichia coli
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSSNNNNNNNNNNLGDDDDKVPHMSMGGRDIVD

SEQ ID NO: 1517 - protein, 398 aa, Artificial Sequence
  His tagged maltose binding protein
MHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELG

SEQ ID NO: 1518 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDKGSAASEDLAVFNPSTSNGYKMVGQFGQRNHASVADGHAPIFKDLFDLGVLKAPVGWQRVWDDAGSGKHHDYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 1519 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1520 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1521 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYLLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSDMEKQVNSFRSNSTIRLTATGGKPGMTDRILHGPDSQQAFSQWAESLLDYATLMDFSTESLQPIWALADLPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMESMLSQHQGMEAMMSKL

SEQ ID NO: 1522 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1523 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYYLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1524 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGEYYLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSQMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1525 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLVNRVWWDKGTGARKDVSLWQPGAAGAVASSCFAGVPNYNNPPNSGDIERLRGSIACVKTSAIASMQEMKSMLSQHQGMEAMMSKL

SEQ ID NO: 1526 - protein, 536 aa, Artificial Sequence
  PHI-4 polypeptide variant
MRSAANAGQLGNLPGVTSMGMGYDVNGLYASPESLLGQPLFDFGGELDSIEIEGRSYTFPRSMHVHTYFHSDFKQDVSKEIEEYREKMSQHVGVSGDYKLFSASLSVDFTTTDQQLTEITYSSTREAHVLWYISLPGAATLRSMLRRDFRDDLNNPNMPAMELFKRYGPYYISEAAVGGRLDYSAASKTLKMDSSQSLSTTAEMSYKALVGEIKIEHGSEMEKQVNSFRSNSTIRLTATGGKPGMTDRILHGPDSQQAFSQWAESLLDYATLMDFSTESLQPIWALADKPERRVELEDAFPEFMKQSQQSIPKVDKVLLMDARPPMVKAGEDSGSGASEDLAVFNPSTSNGYKMVGQFGQRNHASVADGHAPIFKDLFDLGVLKAPVGWQRVWDDAGSGKSKYYACWRAIPPQGYRALGDVMMLATSGYNPPNLPDYVCVHQSLCADVQTLQNRVWWDKGTGARKDVSLWDPGAAGAVASSCFAGVPNYNNPPNSGDIERLRGSIACVKTSAIASMQEMKSMLSQHQGMEAMMSKL

SEQ ID NO: 1527 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagataaaggcagcgcggcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagcatcatgattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatggagagcatgttgagccagcaccagggtatggaagcgatgatgtctaaactg

SEQ ID NO: 1528 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1529 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactatttgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1530 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactatttgctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgatatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggatctgccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatggagagcatgttgagccagcaccagggtatggaagcgatgatgtctaaactg

SEQ ID NO: 1531 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1532 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactattatctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1533 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgaatattatctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagccagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1534 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctggtcaaccgcgtttggtgggataagggtaccggtgcgcgtaaggacgtgagcctgtggcaaccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

SEQ ID NO: 1535 - DNA, 1608 bp, Artificial Sequence
  PHI-4 polypeptide variant coding sequence
atgcggtctgcggcgaatgcaggccaactgggtaacttgcctggcgtcacgagcatgggcatgggttacgacgtgaacggtctgtatgcgagcccggaaagcctgttgggccaaccgttgtttgacttcggtggtgagctggacagcatcgaaattgaaggccgtagctatacctttccacgctccatgcacgttcatacgtacttccatagcgacttcaaacaagacgttagcaaagagatcgaagagtatcgcgagaagatgtcgcagcacgtgggtgtcagcggtgactataagctgttcagcgcttctttgtctgtcgatttcaccacgactgaccaacaattgaccgagattacctatagcagcacccgcgaggcgcatgtgctgtggtatatcagcctgccgggtgccgctactctgcgtagcatgttgcgtcgcgacttccgtgatgatttgaacaatccgaatatgccggccatggagctgtttaagcgttacggcccgtactacattagcgaggcggcagtcggcggtcgcctggactactctgcagcgagcaaaaccctgaagatggattccagccagtctctgagcactacggcggaaatgagctacaaagcgctggttggtgagatcaaaatcgaacacggtagcgagatggaaaaacaagtcaacagctttcgtagcaactcgacgattcgcctgaccgccacgggtggtaaaccgggtatgaccgatcgtatcctgcacggtccggatagccagcaggcgttcagccagtgggcggagtccctgctggattatgccacgctgatggactttagcacggagtcgctgcagccgatttgggcactggcggataaaccagagcgtcgtgtggagctggaggatgcgtttccggagtttatgaaacagtctcaacaaagcattccgaaagtggataaagtgctgctgatggatgcccgtccgccgatggttaaggcgggtgaagatagcggcagcggcgcaagcgaggacctggcggtgttcaatccgagcaccagcaacggctacaagatggtcggccagtttggccaacgcaaccatgctagcgtggcagacggccacgctccgatcttcaaggacctgttcgatctgggtgttttgaaagccccggtgggctggcagcgtgtgtgggacgacgcaggctccggtaagagcaagtattacgcatgttggcgtgccattccgccgcaaggttaccgtgccttgggtgacgttatgatgctggctaccagcggctacaatccacctaatctgccggactatgtttgcgttcaccagtccctgtgcgccgacgtccagacgctgcagaaccgcgtttggtgggataagggtaccggtgcgcgtaaggacgtgagcctgtgggacccgggtgcggctggcgcagttgcgtctagctgttttgccggtgtcccgaattacaataacccgcctaacagcggcgatatcgagcgtctgcgtggtagcattgcctgtgtcaagacctccgcaattgcatccatgcaagaaatgaagagcatgttgagccagcaccagggtatggaagcgatgatgtctaaactg

That which is claimed:

1. A variant polypeptide comprising the amino sequence of SEQ ID NO: 35 having an amino acid substitution at position 97 of SEQ ID NO: 35 selected from Asp, Glu or Asn, wherein the variant polypeptide has at least 1.3 fold improved insecticidal activity against Western Corn Root Worm (WCRW) larvae compared to the polypeptide of SEQ ID NO 35.

2. The variant polypeptide of claim 1, wherein the amino acid at position 97 of SEQ ID NO: 35 is substituted with Asp.

3. The variant polypeptide of claim 1, wherein the amino acid at position 97 of SEQ ID NO: 35 is substituted with Glu.

4. The variant polypeptide of claim 1, wherein the amino acid at position 97 of SEQ ID NO: 35 is substituted with Asn.

5. A composition, comprising an insecticidally-effective amount of the PHI-4 polypeptide of claim 1, 2, 3 or 4.

6. A method of inhibiting growth or killing an insect pest, comprising contacting the insect pest with the composition of claim 5.

7. A method for controlling an insect pest population resistant to a pesticidal protein, comprising contacting the resistant insect pest population with the composition of claim 5.

8. The method of controlling an insect pest population resistant to an pesticidal protein of claim 7, wherein the pesticidal protein is selected from the group consisting of Cry1Ac, Cry1Ab, Cry1A.105, Cry1Ac, Cry1F, Cry1Fa2, Cry1F, Cry2Ab, Cry3A, mCry3A, Cry3Bb1, Cry34Ab1, Cry35Ab1, Vip3A, Cry9c, eCry3.1Ab and CBI-Bt.

9. A method for protecting a plant from an insect pest, comprising expressing in the plant or cell thereof, an insecticidally-effective amount of the variant polypeptide of claim 1, 2, 3 or 4.

10. A method for controlling an insect pest population, comprising contacting the insect pest population with an insecticidally-effective amount of the variant polypeptide of claim 1, 2, 3 or 4.

11. A method of inhibiting growth or killing an insect pest, comprising contacting the insect pest with a composition comprising an insecticidally-effective amount of the variant polypeptide of claim 1, 2, 3 or 4.

12. A method for controlling an insect pest population resistant to a pesticidal protein, comprising contacting the insect pest population with an insecticidally-effective amount of the variant polypeptide of claim 1, 2, 3 or 4.

13. A fusion protein comprising the variant polypeptide of claim 1, 2, 3 or 4.

* * * * *